United States Patent 12,569,549 (FLAVIVIRUS VACCINE) - sequence listing, part 31

SEQ ID NO: 12369 - RNA, 9873 nt, synthetic construct
  misc_feature 1..9873: note = derived and/or modified CDS sequence (opt2) from DENV-2__HQ012537__SS-prME
  source 1..9873: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgtcaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctccgcatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaagcacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgccgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctgg

SEQ ID NO: 12370 - RNA, 9876 nt, synthetic construct
  misc_feature 1..9876: note = derived and/or modified CDS sequence (opt2) from DENV-2__KU365901__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccaggagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgcaactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgagttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtcaccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggcgcgtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggccgcaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12371 - RNA, 9876 nt, synthetic construct
  misc_feature 1..9876: note = derived and/or modified CDS sequence (opt2) from DENV-2__GQ398258__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgaccccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctacaagggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtcaagaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccaccagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctgggtccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12372 - RNA, 9876 nt, synthetic construct
  misc_feature 1..9876: note = derived and/or modified CDS sequence (opt2) from DENV-2__GQ398259__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctacaagggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtcaagaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccaccagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctgggtccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12373 - RNA, 9876 nt, synthetic construct
  misc_feature 1..9876: note = derived and/or modified CDS sequence (opt2) from DENV-2__GQ398268__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12374 - RNA, 9876 nt, synthetic construct
  misc_feature 1..9876: note = derived and/or modified CDS sequence (opt2) from DENV-2__GQ398263__SS-prME
  source 1..9876: mol_type = other RNA
accgccggcatgatcatcatgatgatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaccaccaaccgcgcctggaactccctcgaggtcgaggactacggcttcggcgtcttcaccaccaacatctggctcaagctcaaggagcgccaggacgtcctctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggacaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacgtcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatctacaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12375 - RNA, 9876 nt, synthetic construct
  misc_feature 1..9876: note = derived and/or modified CDS sequence (opt2) from DENV-2__GQ398264__SS-prME
  source 1..9876: mol_type = other RNA
accgccggcatgatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggatgatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcagctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccaccgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12376 - RNA, 9876 nt, synthetic construct
  misc_feature 1..9876: note = derived and/or modified CDS sequence (opt2) from DENV-2__GQ398260__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaagatcaccccccagtcctccatcaccgaggccgagctcatcggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcaacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatcggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12377 - RNA, 9876 nt, synthetic construct
  misc_feature 1..9876: note = derived and/or modified CDS sequence (opt2) from DENV-2__GQ398262__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtccgcctcaccatcatgaccggcgacatcaagggcatcatgcaggccggcaagcgctccctccgcccccagcccaccgagctcaagtactcctggaagacctggggcaaggccaagatgctctccaccgagctccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcaacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12378 - RNA, 9876 nt, synthetic construct
  misc_feature 1..9876: note = derived and/or modified CDS sequence (opt2) from DENV-2__GQ398261__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctggatcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcaacttctgcgagggcaccaccgtcgtcgtcaccggcgactgcggcaaccgcggccccgccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatcggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12379 - RNA, 9876 nt, synthetic construct
  misc_feature 1..9876: note = derived and/or modified CDS sequence (opt2) from DENV-2__GQ398313__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatgctcctcgtcgccgtctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12380 - RNA, 9876 nt, synthetic construct
  misc_feature 1..9876: note = derived and/or modified CDS sequence (opt2) from DENV-2__GQ398285__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcatgggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcaccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcggcatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacctcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcgtcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcgcccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12381 - RNA, 9876 nt, synthetic construct
  misc_feature 1..9876: note = derived and/or modified CDS sequence (opt2) from DENV-2__GQ398298__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcctcctcggcatggccctcttcctcgaggagatgctccgcacccgcgtcggcaccaagcacgccatgctcctcgtcgtcgtctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacatcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12382 - RNA, 9876 nt, synthetic construct
  misc_feature 1..9876: note = derived and/or modified CDS sequence (opt2) from DENV-2__GQ398301__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatgctcctcgtcgccgcctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12383 - RNA, 9876 nt, synthetic construct
  misc_feature 1..9876: note = derived and/or modified CDS sequence (opt2) from DENV-2__GQ398312__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatgctcctcgtcgccgtctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcatcgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12384 - RNA, 9876 nt, synthetic construct
  misc_feature 1..9876: note = derived and/or modified CDS sequence (opt2) from DENV-2__GQ398289__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcatcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccctcttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgccgcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12385 - RNA, 9876 nt, synthetic construct
  misc_feature 1..9876: note = derived and/or modified CDS sequence (opt2) from DENV-2__GQ398290__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacttcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgagaactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacaccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12386 - RNA, 9876 nt, synthetic construct
  misc_feature 1..9876: note = derived and/or modified CDS sequence (opt2) from DENV-2__GQ398284__SS-prME
  source 1..9876: mol_type = other RNA
accgccggcgtcatcatcatgctcatccccaccgccatggccttccacctcaccacccgcaacggcgagccccacatgatcgtcggcaagcaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcctctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgccctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctaccgcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaaccacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12387 - RNA, 9876 nt, synthetic construct
  misc_feature 1..9876: note = derived and/or modified CDS sequence (opt2) from DENV-2__GQ398308__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatgctcctcgtcgccgtctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacgacacccagttctgcatcaaggtcctcaacccctacatgccctccgtcatcgagaagatggagaccctccagcgcaagtacggcggcgccatcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12388 - RNA, 9876 nt, synthetic construct
  misc_feature 1..9876: note = derived and/or modified CDS sequence (opt2) from DENV-2__GQ398287__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacctcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcatcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccctcttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccgtcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgccgcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12389 - RNA, 9876 nt, synthetic construct
  misc_feature 1..9876: note = derived and/or modified CDS sequence (opt2) from DENV-2__GQ398302__SS-prME
  source 1..9876: mol_type = other RNA
accgccggcgtcatcatcatgctcatccccaccgccatggccttccacctcaccacccgcaacggcgagccccacatgatcgtctcccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatgctcctcgtcgccgtctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12390 - RNA, 9876 nt, synthetic construct
  misc_feature 1..9876: note = derived and/or modified CDS sequence (opt2) from DENV-2__GQ398272__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcatcgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12391 - RNA, 9876 nt, synthetic construct
  misc_feature 1..9876: note = derived and/or modified CDS sequence (opt2) from DENV-2__GQ398292__SS-prME
  source 1..9876: mol_type = other RNA
accgccggcgtcttcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcatgcgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatgctcctcgtcgccgtctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12392 - RNA, 9876 nt, synthetic construct
  misc_feature 1..9876: note = derived and/or modified CDS sequence (opt2) from DENV-2__GQ398267__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcatcgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacatcggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcatcgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12393 - RNA, 9876 nt, synthetic construct
  misc_feature 1..9876: note = derived and/or modified CDS sequence (opt2) from DENV-2__GQ398266__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcatcgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12394 - RNA, 9876 nt, synthetic construct
  misc_feature 1..9876: note = derived and/or modified CDS sequence (opt2) from DENV-2__GQ398265__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12395 - RNA, 9876 nt, synthetic construct
  misc_feature 1..9876: note = derived and/or modified CDS sequence (opt2) from DENV-2__KX702403__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcctcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcgagaagcgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccccacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagaccgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 12396 - RNA, 9876 nt, synthetic construct
  misc_feature 1..9876: note = derived and/or modified CDS sequence (opt2) from DENV-2__KX702404__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgagatcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcgtcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccaacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 12397 - RNA, 9873 nt, synthetic construct
  misc_feature 1..9873: note = derived and/or modified CDS sequence (opt2) from DENV-2__JQ686088__SS-prME
  source 1..9873: mol_type = other RNA
accaccggcatgatcatcatgctcatccccaccgtcatggccttccacctcaccacccgcaacggcgagccccacatgatcgtctcccgccaggacaagggcaagtccctcctcttcaagaccaaggacggcaccaacatgtgcaccctcatggccatggacctcggcgagctctgcgaggacaccatcacctacaagtgccccttcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatcgccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatgaagggcaagatcgtccagcccgagaacctcgagtacaccatcgtcatcaccccccactccggcgaggagcacgccgtcggcaacgacaccggcaagcacggcaaggaggtcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggaccgccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggcaacggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggtcggcaagcgctccctccagccccagcccaccgagctccgctactcctggaagacctggggcaaggccaagatgctctccaccgagctccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacctcgccggccccgtctcccagcacaacaaccgccccggctactacacccagaccgccggcccctggcacctcggcaagctcgagatggacttcgacttctgcaagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcatcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtcctccatccccgagaccatcctcgagctcaccgacgccctcgccctcggcatgatgatcctcaagatggtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccatcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcgtctccggcctcttccccgtctccgtccccatcaccgccgccgcctggtacctctgggaggtcaagaagcagcgcgccggcgtcctctgggacgtcccctcccccccccccgccggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccgtccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaagaccggcaacgacatcgccgcctgcctccgcaagaacggcaagcgcgtcatccagctctcccgcaagaccttcgactccgagtacatcaagacccgcaccaacgactgggacttcgtcgtcaccaccgacatctccgagatgggcgccaacttcaaggcccagcgcgtcatcgacccccgccgctgcatgaagcccgtcatcctcaccgacggcgaggagcgcgtcatcctcgccggccccatgcccgtcacccactcctccgccgcccagcgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcacccgcaacaaccagatcctcgaggagaacgtcgaggtcgagatctggaccaaggagggcgagcgcaagaagctcaagccccgctggctcgacgcccgcatctacgccgaccccctcgccctcaaggagttcaaggagttcgccgccggccgcaagtccctcaccctcaacctcatcaccgagatgggccgcctccccaccttcatgacccagaaggtccgcgacgccctcgacaacctcgccgtcctccacaccgccgaggccggcggcaaggcctacaaccacgccctcaacgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgtcacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccgtctccaccctctgggagggcaaccccggccgcttctggaacaccaccatcgccgtctccatggccaacatcttccgcggctcctacctcgccggcgccggcctcctcttctccatcatgaagaacaccacctccgcccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagcgctgcgacaccctcctctgcgacatcggcgagtcctccccctcccccaccgtcgaggccggccgcaccctccgcgtcctcaacctcgtcgagaactggctctccaacaacacccagttctgcgtcaaggtcctcaacccctacatgccctccgtcatcgagaagatggaggccctccagcgcaagcacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcggcgacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccatcgaggacctcaagaacgaggagatgatcaccaaccacatggagggcgagcacaagaagctcgccgaggccatcttccgcctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgccgccgaggagatcgccgtccagaactggctcgtccgcgtcggccgcgagcgcctctcccgcatggccatctccggcgacgactgcgtcgtcaagcccctcgacgaccgcttcgcccgcgccctcaccgccctcaacgacatgggcaaggtccgcaaggacatccagcagtgggagccctcccgcggctggaacgactggacccaggtccccttctgctcccaccacttccacgagctcatcatgaaggacggccgcatcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcctcccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12398 - RNA, 9876 nt, synthetic construct
  misc_feature 1..9876: note = derived and/or modified CDS sequence (opt2) from DENV-2__KF479233__SS-prME
  source 1..9876: mol_type = other RNA
accgccggcgtcatcatcatgctcatccccaccgccatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagccccagaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctacaagggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgagctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagaagaagaagctcaagccccgctggctcgacgcccgcatctactccgaccccctcgccctcaaggagttcaaggagttcgccgccggccgcaagtccctcaccatgaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgtcacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagtccatccagcacctcaccaccaccgaggaggtcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggctccgaggagtacaccgactacatgccctccatgaagcgcttccgccgcgaggaggaggaggccggcgtcctctggtga

SEQ ID NO: 12399 - RNA, 9876 nt, synthetic construct
  misc_feature 1..9876: note = derived and/or modified CDS sequence (opt2) from DENV-2__KX372564__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaaggtcctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtctcctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccgccctcgccgtcgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccttcctcaagaacgacatccccatgaccggccccctcgtcgccggcggcctcctcaccgtctgctacgtcctcaccggccgctccgccgacctcgagctcgagcgcgccgccgacatccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggccgcgccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcgtcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgccgctacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgccaccgaggagatcgccgtcaagaactggctcgtccgcgtcggccgcgagcgcctctcccgcatggccatctccggcgacgactgcgtcgtcaagcccttcgacgaccgcttcgccaacgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12400 - RNA, 9873 nt, synthetic construct
  misc_feature 1..9873: note = derived and/or modified CDS sequence (opt2) from DENV-2__KX274130__SS-prME
  source 1..9873: mol_type = other RNA
tccgccgccaccctcctcctcctcgtccccaccatcatggccttccacctcaccacccgcaacggcgagccccacatgatcgtcgcccgccacgagaagggcaagtccctcatcttcaagaccgagaacggcgtcaacatgtgcaccctcatggccatggacctcggcgagctctgcgaggagaccgtcacctacaagtgcccctacctcaagcagtccgagcccgaggacatcgactgctggtgcaacaccacctccacctgggtcacctacggcacctgctcctcctccggcgagcaccgccgcgagaagcgctccgtcgccctcgccccccacgtcggcatgggcctcgagacccgcaccgagacctggatgtcctccgagggcgcctggaagcacgcccagcgcatcgagaactggatcctccgccaccccggctacaccgtcatggccgccgccatcgccatggccatcggcaccaacaacttccagcgcgccctcatcttcgtcctcctcaccgccgtcgccccctccatgaccatgcgctgcgtcggcatcgccaaccgcgacttcgtcgagggcgtctccggcggctcctgggtcgacatcgtcctcgagcacggctcctgcgtcaccaccatggccaagaacaagcccaccctcgacttcgagctcaccaagaccgaggccaagctccccgccaccctccgcaagtactgcatcgaggccaagctcaccaacaccaccaccgagtcccgctgccccacccagggcgagccctccctccccgaggagcaggacaagcgcttcatctgccgccactccctcgtcgaccgcggctggggcaacggctgcggcctcttcggcaagggcggcatcgtcacctgcgccatgttcacctgcaagaagtacatggagggcaagatcgtccagcccgagaacctcgagtacaccgtcgccgtcaccccccactccggcgaggagcactccgtcggcaacgacaccggcaagcacggccaggacgtcaagatcaccccccagtcctccatcaccgagaccgccctcgagggctacggctccatctccatggagtgctccccccgcaccggcctcgacttcaacgagatggtcctcctccagatggaggacaaggcctggctcgtccaccgccagtggttcctcgacctccccctcccctggctccccggctccgacacccagggctccaactgggtccagaaggagaccctcgtcaccttcaagaacccccacgccaagaagcaggacgtcgtcgtcctcggctcccaggagggcgccatgcactccgccctcaccggcgccaccgagatccagatgacctccggcaacctcctcttcaccggccacctcaagtgccgcctccgcatggacaagctcgagctcaagggcatgtcctactccatgtgcaccggcaagttcaaggtcgtcaaggagatcgccgagacccagcacggcaccatcgtcatccgcgtccagtacgagggcgagggctccccctgcaagatccccttcgagatcatggacctcgagaagaagcacgtcctcggccgcctcatcaccgtcaaccccatcatcaccgagaaggacaagcccaccaacatcgaggccgagccccccttcggcgactcctacatcctcatcggcgtcgagcccggccagctcaagatgaactggttcaagaagggctcctccatcggccagatgttcgagaccaccatgcgcggcgccaagcgcatggccatcctcggcgacaccgcctgggacttcggctccctcggcggcgtcttcaactccatcggcaaggccctccaccaggtcttcggcgccgtctacaacgccgccttctccggcgtctcctggaccatgaagatcctcatcggcgtcatcatcacctggatcggcatgaactcccgctccacctccatgtccatcaccctcgtcatggtcggcctcgtcaccctctacctcggcgtcgtcgtccaggccgactccggctgcgtcgtctcctggaagaccaaggagctcaagtgcggctccggcatcttcgtcaccgacaacgtccacgtctggaccgagcagtacaagttccagcccgagtcccccgccaagctcgccgccgccatcaagaaggcccacgaggagggcgtctgcggcatccgctccgtcacccgcctcgagaacatcatgtggaagcagatcacccccgagctcaaccacatcctcaccgagaacgacgtcaaggtcaccatcatgaccggcgacatcaagggcatcctccagcagggccgccgcgccctccgcccccagcccaccgagctcaagtactcctggaagtcctggggcaagtccaagatcgtctcctccgagacccacaaccagaccttcctcatcgacggccccgagaccaccgagtgccccgacaccaaccgcgcctggaactccctcgaggtcgaggactacggcttcggcctcttctccaccaacatctggctccgcctccgcgagaagcaggacaccctctgcgactccaagctcatgtccgccgccgtcaaggacgagcgcgccatccacgccgacatgggctactggatcgagtccaagctcaacggctcctggaagatcgagaaggcctccttcctcgaggtcaagtcctgcacctggccccgctcccacaccctctggtccaacggcgtcctcgagtccgagatgatcatccccaagaacctcggcggccccgtctcccagcacaactaccgccccggctactacacccagaccaccggcccctggcacctcggcaagctcgagatggacttcgactactgcgagggcaccaccgtcatcgtcaccgaggagtgcaacaaccgcggcccctccctccgcaccaccaccgcctccggcaagctcatcaccgagtggtgctgccgctcctgcaccatgccccccctccgcttcaagggcgaggacggctgctggtacggcatggagatccgccccctcaaggagaaggaggagaacctcgtcaactccctcgtcaccgccggccacggccagatcgacaacttctccctcggcatcctcggcatcgccctcttcctcgaggaggtcatgaagtcccgcatcggcatcaagcacaccatcggcatgaccatcatcaccttcctcctcctcgtcaccggcaacgtctcctaccgcgacctcggccgcgtcatcctcatggtcggctccaccatggccgacgagatgggcatgggcgtcacctacctcgccctcctcgccaccttccgcatccgccccaccttcgccctcgccctcatgatccgcaagctcacctccaaggagctcctcatggccaccatcggcatcgtcctcatcgcccagtgcgacgtccccggcaccatcctcgagatcaccgacgcctgcgccctcggcctcatgctcctcaagatgacccgcgagctcgagcgctaccagctcgccgtcaccctcctctccctcacctgcatccccaacgccaccatcatgtggggcgcctggaaggtcacctgcaccatcctcaccctcgtctccatggcccccctcttcctcaccacctcccgccagaagaccgactgggtccccgtcgccctctccatctacggcctcaaccccaccgccatctacttcaccaccctcgccaaggccaagaagatccgctcctggcccctcaacgaggccgtcatggccgtcggcatggtctccatcctcgcctcctccctcctccgcaacgacatccccatggccggccccctcgtcgccggcggcctcctcaccctctgctacgtcctcaccggccgctccgccgacctcgagctcgagaagtccgccgacatcaagtggaacgacgacgccgagatctccggctcctcccccatcatcaacgtcgccgtctccgaggacggctccatgtccatcaaggacgaggaggaggagaacaccctcaccatcctcatccgcaccggcctcctcgccatctccggcatgtaccccatggccatccccgccaccgccgccgtctggtacttctgggaggcccgcaagcagcgcgccggcgtcctctgggacgtcccctcccccccccccaccggcaaggccgagctcgaggagggcgcctaccgcatcaagcagcgcggcatcttcggctactcccagatcggcgccggcgtctacaaggagggcaccttccacaccatgtggcacgtcacccgcggctccgtcctcatgtgcaagggcaagcgcctcgagccctcctgggccgacgtcaagaaggacctcatctcctacggcggcggctggcgcctcgacggcgagtggaccgagggcgaggaggtccaggtcctcgccctcgagcccggcaagaacccccgcgccgtccagaccaagcccggcatgttcaagaccgacaccggccgcatcggcgccgtctccctcgacttcgcccccggcacctccggctcccccatcatcgacaagaagggcaaggtcatcggcctctacggcaacggcgtcgtcatgaagtccggcgcctacgtctcctccatcgcccagaccgagaagcgcgaggacgagatccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatcgccacccgcgtcgagatgggcgaggccgccggcatcttcatgaccgccaccccccccggctccaaggaccccttcccccagtccaacgcccccatcatggacgaggagcgcgagatccccgagcgctcctggaactccggccacgagtggatcaccgacttcgagggcaagaccgtctggttcgtcccctccatccgcgccggcaacgacatcgccacctgcctccgcaagaacggcaagaaggtcatccagctctcccgcaagaccttcgacaccgagtacatcaagacccgcaacaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcaccccctcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatccccgccatgttcggccccgagcgcgagaagaccgacgccatcgacggcgagtaccgcctccgcggcgagtcccgcaagaccttcgtcgagctcatgcgccgcggcgacctccccgtctggctcgcctacaaggtcgcctccgagggctactcctacgccgaccgccgctggtgcttcgagggcgtcaagaacaaccagatcctcgaggagaacctcgaggtcgagatctggaccaaggagggcgagcgcaagaagctccgccccaagtggctcgacgcccgcacctactccgacccccaggccctcaaggacttcaaggagttcgccgccggccgcaagtccaccaccctcaacctcatcgccgagctcggccgcctccccacctacatgacccagaagacccgcgacgccctcgacaacctcgccgtcctccacaccgccgaggagggcggccgcgcctaccagcacgccatctccgagctccccgagaccctcgagaccctcctcctcctctgcctcctcgccaccgtctccggcggcgtcttcctcttcctcatgtccggcaagggcatcggcaagatgtccatgggcctcggctgcatcatcaccgcctccggcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccctcgtcgccgccaccatggccaacgagatgggctacctcgagaagaccaagaaggacctcggcttcggcaacccctacgtcgcctcccacgaggccgccatcctcgacatcgacctccaccccgcctccgcctggaccctctacgccgtcgccaccaccctcatcacccccatgctccgccactccatcgagaactcctccaccaacgtctccctcaccgccatcgccaaccaggccaccgtcctcatgggcctcggcaagggctggcccctctcccgcatggacctcggcgtccccctcctcgccctcggctgctactcccaggtcaaccccctcaccctcaccgcctccctcctcctcctcatcggccactacgccatcatcggccccggcctccaggccaaggccacccgcgaggcccagaagcgcaccgccgccggcatcatgaagaaccccaccgtcgacggcatcaccgtcatcgacatcgagcccatcccctacgaccccaagttcgagaagcagctcggccaggtcatgctcctcgtcctctgcgtcgcccaggtcctcatgatgcgcaccacctgggccatgtgcgaggccctcaccatcgccaccggccccatctccaccctctgggagggcaaccccggcaagttctggaacaccaccatcgccgtctccatggccaacatcttccgcggctcctacctcgccggcgccggcctcctcttctccatcatgaagaacaccgtcaccggccgccgcggcaccggcgtcgccggcgagaccctcggcgagaagtggaagatcaagctcaacggcctcggccgcaccgacttccagacctacaagcgctccggcatcatcgaggtcgaccgcaccctcgccaaggagggcatcaagcgcggcgagaccaaccaccacgccgtctcccgcggctccgccaagctccgctggttcgtcgagcgcaacctcgtcaagcccgagggcaaggtcatcgacctcggctgcggccgcggcggctggtcctactactgcggcggcctcaagaacgtcaccgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacatggtcgagaactggctcggcaacaaccagttctgcatcaaggtcctcaacccctacatgccctccgtcatcgagaagatggagaacctccagcgcaagttcggcggcaccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaagcccacctacgagcaggacgtcgacctcggctccggcacccgcaacgtcggcatcgagaccgagaagcccaacctcgagatcatcggcaagcgcatcgagaagatcaaggacgagcacaagcagacctggcactacgacctcgaccacccctacaagacctgggcctaccacggctcctacgagaccaagcagaccggctccgcctcctccatgatcaacggcgtcgtcaagctcctcaccaagccctgggacgtcatccccatggtcacccagatggccatgaccgacaccacccccttcggccagcagcgcgtcttcaaggagaaggtcgacacccgcacccccgagcccaaggagggcaccaagaagctcatgaagctcaccgccaagtggctctgggccgagctcggccgccacaaggtcccccgcatgtgcacccgcgacgagttcaccaacaaggtccgctccaacgccgccatgggcgccgtcttcaccgaggagaaccgctggtcctccgccaaggaggccgtcgaggacgaggccttctgggacctcgtcgaccgcgagcgcaagctccacctccagggcaagtgcgagacctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgagatcggcgccaaggacggcggcatgatgtacgccgacgacaccgccggctgggacacccgcgtcaccgaggaggacctcaagaacgaggagatgatctccgagcagatgaagggcgagcaccgcaccctcgccgaggccatcttcaagctcacctaccagaacaaggtcgtccgcgtccagcgccccacccccaagggcaccgtcatggacatcatctcccgccgcgaccagcgcggctccggccaggtcggcacctacggcctcaacaccttcaccaacatggaggcccagctcatccgccagatggagggcgagggcctcttccgcgacatctccaagctcaccatccaggaggagaccgccatcctcacctggctcaaggagaagggccgcgaccgcctctcccgcatggccatctccggcgacgactgcgtcgtcaagcccgtcgacgaccgcttcgcccacgccctcaccgccctcaacgacatgggcaaggtccgcaaggacatccagcagtgggaggcctccaagggctggaacgactggacccaggtccccttctgctcccaccacttccacgagatcatcatgaaggacggccgcaagctcgtcgtcccctgccgcaaccaggacgagctcatcggccgcgcccgcatctcccagggcgccggctgggccctcaaggagaccgcctgcctcggcaaggcctacgcccagatgtggtccctcatgtacttccaccgccgcgacctccgcctcgccgccaacgccatctgctccgccgtcccctcccactgggtccccacctcccgcaccacctggtccatccacgcccaccaccagtggatgaccaccgaggacatgctcgacgtctggaaccgcgtctggatcctcgagaacccctggatggacgacaagacctgcgtcaagtcctgggaggaggtcccctacctcggcaagcgcgaggaccagtggtgcggctccctcatcggcctcacctcccgcgccacctgggccaagaacatcaaggtcgccatcgagcaggtccgctccctcatcggcaaggaggagtacaccgactacatgccctccatgaagcgcttcaagcaggagcagtccaccgagggcgccctctggtga

SEQ ID NO: 12401 - RNA, 9876 nt, synthetic construct
  misc_feature 1..9876: note = derived and/or modified CDS sequence (opt2) from DENV-2__GU289914__SS-prME
  source 1..9876: mol_type = other RNA
tccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgaccccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttccgcaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12402 - RNA, 9876 nt, synthetic construct
  misc_feature 1..9876: note = derived and/or modified CDS sequence (opt2) from DENV-2__AY858036__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctcgcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgagaccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccgagttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12403 - RNA, 9876 nt, synthetic construct
  misc_feature 1..9876: note = derived and/or modified CDS sequence (opt2) from DENV-2__HQ332184__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcatccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccggctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccaccctcctcgtcgccgcctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12404 - RNA, 9876 nt, synthetic construct
  misc_feature 1..9876: note = derived and/or modified CDS sequence (opt2) from DENV-2__HQ332185__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcatccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagatcaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaagaacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12405 - RNA, 9876 nt, synthetic construct
  misc_feature 1..9876: note = derived and/or modified CDS sequence (opt2) from DENV-2__HQ332186__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccttctggtccaacggcgtcctcgagtccgagatgatcatccccaagaacttcgccggccccgtctcccagcacaactaccgccccggctaccacacccagatcgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacacctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12406 - RNA, 9876 nt, synthetic construct
  misc_feature 1..9876: note = derived and/or modified CDS sequence (opt2) from DENV-2__HQ332187__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcatccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatgatcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgtcatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttcggcgagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12407 - RNA, 9876 nt, synthetic construct
  misc_feature 1..9876: note = derived and/or modified CDS sequence (opt2) from DENV-2__HQ332188__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcgtcatgcaggccggcaagcgctccctccgcccccagcccaccgagctcaagtactcctggaagacctggggcaaggccaagatgctctccaccgagtcccacaaccagaccttcctcatcgacggccccgagaccaccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagatcgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgccacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggagatccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12408 - RNA, 9876 nt, synthetic construct
  misc_feature 1..9876: note = derived and/or modified CDS sequence (opt2) from DENV-2__HQ332189__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagaactggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacgtcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctccccctcccccaccatcgaggccggccgcaccctccgcgtcctcaacctcgtcgaggactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacacctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12409 - RNA, 9876 nt, synthetic construct
  misc_feature 1..9876: note = derived and/or modified CDS sequence (opt2) from DENV-2__JN368476__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagtccaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagaccgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcaccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaacaccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12410 - RNA, 9876 nt, synthetic construct
  misc_feature 1..9876: note = derived and/or modified CDS sequence (opt2) from DENV-2__JF260983__SS-prME
  source 1..9876: mol_type = other RNA
accgccggcttcctcatcatggtcatccccaccgtcatggccttccacctcaccacccgcaacggcgagccccacatgatcgtctccaagaacgagaagggcaagggcctcctcttcaagaccgagaacggcatcaacatgtgcaccctcatggccatggacctcggcgagctctgcgaggacaccgtcacctacaagtgccccttcctcaagcagaacgagcccgaggacatcgactgctggtgcaactccacctccacctgggtcacctacggcacctgctcctccaccggcgagcaccgccgcgagaagcgctccgtcgccctcgtcccccacgtcggcatgggcctcgagacccgcaccgagacctggatgtcctccgagggcgcctggaagcaggcccagcgcatcgagacctggatcctccgccaccccggcttcaccctcatggccgccgtcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagttctgcatcgaggccaagctcaccaacaccaccaccgagtcccgctgccccacccagggcgagccctccctcgtcgaggagcaggacaagcgcttcgtctgccgccactccatggtcgaccgcggctggggcaacggctgcggcctcttcggcaagggcggcatcgtcacctgcgccatgttcacctgcctcaagaagatggagggcaaggtcgtccagcccgagaacctcgagtacaccatcgtcatcaccccccactccggcgaggagcacgccgtcggcaacgacaccggcaagcacggcaaggaggtcaagatcaccccccagtcctccatctccgagaccgagctcaccgactacggcaccatcaccatggagtgctccccccgcaccggcctcgacttcaacgagatggtcctcctccagatggagtccaaggcctggctcgtccaccgccagtggttcctcgacctccccctcccctggctccccggcgccgacacccagggctccaactggatccagaaggagatgctcgtcaccttcaagaacccccacgccaagcgccaggacgtcgtcgtcctcggctcccaggagggcgccatgcacaccgccctcaccggcgccaccgagatccagatgtccctcggcaacatcctcttcatgggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacgactccccctgcaagatccccttcgagatcatggacctcgagaagaagcacgtcctcggccgcctcatcaccgtcaaccccatcgtcaccgagaaggactcccccatcaacatcgaggccgagccccccttcggcgactcctacatcgtcatcggcgtcgagcccggccagctcaagctcaactggttcaagaagggctcctccatcggccagatgttcgagaccaccatgcgcggcgccaagcgcatggccatcctcggcgacaccgcctgggacttcggctccatcggcggcgtcttcacctccgtcggcaaggccctccaccaggtcttcggcgccatctacggcgccgccttctccggcgtctcctggaccatgaagatcctcatcggcgtcgtcatcacctggatcggcatgaactcccgctccacctccctctccgtcaccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgactccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgagatcaagggcatcatgcaggccggccgccgctccctcaagccccagcccaccgagctccgctactcctggaagacctggggcaaggccaaggtcctctccaccgagctccagaaccagaccttcctcatcgacggccccgagaccaccgagtgccccaactccaaccgcgcctggaactccctcgaggtcgaggactacggcttcggcatcttcaccaccaacatctggctcaagctccgcgagaagcaggacatgatctgcgactccaagctcatgtccgccgccgtcaaggacgaccgcgccgtccacgccgacatgggctactggatcgagtcccgcctcaacgacacctggaagatggagaaggcctccttcatcgaggtcaagtcctgctactggccccgctcccacaccctctggtccaacggcgtcctcgagtccgagatgatcatccccaagaacctcgccggccccgtctcccagcacaactaccgccccggctactacacccagaccgccggcccctggcacctcggcaagctcgagatggacttcgagttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagcgcgaggagaacctcgtcaactccctcgtcaccgccggccacggccagatcgacaacttctccctcggcatcctcggcatggccctcctcctcgaggagatgctccgcacccgcgtcggcaccaagcacgccctcctcctcgtcgccatctccttcgtcaccctcatcaccggcaacatgtccttcaaggacctcggccgcgtcatcatcatggtcggcgccgccatgaccgacgagatgggcatgggcgtcacctacctcgccctcctcgccgccttccgcgtccgccccaccttcgccgtcggcctcctcctccgcaagctcacctccaaggagctcctcatggccaccatcggcgtcgtcctcctctcccagtccaacatccccggcaccgtcctcgagctcaccgacgccatcgccctcggcatcatggtcctcaagatcatgcgctccatggagaagtaccagctcgccgtcaccgtcatggccatgctctgcatccccaacgtcatgatcctccagcacgcctggaaggtcggctgcaccatcctcgccgccgtctccgtctcccccctcctcctcacctcctcccagcagaagaccgactggatccccctcgccctcaccatcaagggcctcaaccccaccgccatcttcctcaccaccctctcccgcccctccaagatccgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgaggtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggagaccaagaagcagcgcgccggcgtcctctgggacgtcccctcccccccccccatgggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcgtccacaagggcaagcgcctcgagccctcctgggccgacgtcaagaaggacctcatctcctacggcggcggctggaagctcgagggcgagtggaaggacggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgaccgcaagggcaaggtcgtcggcctctacggcaacggcgtcgtcacccgctccggcacctacgtctcctccatcgcccagaccgagaagtccgtcgaggacaaccccgagatcgaggacgacatcttccgcaagaagcgcctcaccatcatggacctccaccccggcgccggcaagaccaagcgctacctccccgccatcgtccgcgaggccatccgccgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtggatcaccaacttcaagggcaagaccgtctggttcgtcccctccatccgcgccggcaacgacatcgccgcctgcctccgcaagaacggcaagcgcgtcatccagctctcccgcaagaccttcgacaccgagtacaccaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcgtcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgaagcgcggcgacctccccgtctggctcgcctacaaggtcgcctccgagggcatcaactacgccgaccgcaagtggtgcttcgacggcatccgcaacaaccagatcctcgaggagaacatcgaggtcgaggtctggaccaaggagggcgagcgcaagaagctcaagccccgctggctcgacgcccgcacctactccgaccccctcgccctcaaggagttcaaggagttcgccgccggccgcaagtccctcaccctctccctcatcaccgagatgggccgcctccccaccttcatgacccagaagacccgcgacgccctcgacaacctcgccgtcctccactccgccgagatgggcggccgcgcctacaaccacgccctctccgagctccccgagaccctcgagaccctcctcctcctcggcctcctcgccaccgtcaccggcggcatcttcctcttcctcatgtccggccgcggcgtcggcaagatgaccctcggcatgtgctgcatcatcaccgcctccggcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccctcgtcgccgccaccatggccaacgagatgggcttcctcgagaagaccaagaaggacctcggcctcggcggcttcaccatgcagcagcccgagatcaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggcaagttctggaacaccaccatcgccgtctccatggccaacatcttccgcggctcctacctcgccggcgccggcctcctcttctccatcatgcgcaacaccacctccgcccgccgcggcaccggcaccatcggcgagaccctcggcgagaagtggaagtcccgcctcaacgccctcggccgctccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcgcccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagcgctgcgacaccctcctctgcgacatcggcgagtcctcccccaaccccaccgtcgaggccggccgcaccctccgcgtcctcaacctcgtcgagaactggctcggctccaacacccagttctgcatcaaggtcctcaacccctacatgccctccgtcatcgagcgcatggagaccctccagcgcaagttcggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtgcgagacccccaacatggacatcatcggcaagcgcatcgagaagatcaagcaggagcacgaggcctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggggcgagctcggccgccgcaagaagccccgcatctgcacccgcgccgagttctgcaacaaggtccgctccaacgccgccctcggcgccgtcttcaccgacgagaacaagtggaagtccgcccgcgaggccgtcgaggacgagcgcttctgggagctcgtcgagaaggagcgcaacctccacctcgacggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacatctcccgcaaggccggcggcgccatgtacgccgacgacaccgccggctgggacacccgcatcacctccgaggacctcaagaacgaggagatgatcaccgaccagatggagggccgccacaagaagctcgccgaggccatcttccgcctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcctcttcaagtccatcctccacctcaccccccaggaggagaccgccgtccacgcctggctcgtccgcgagggccgcgagcgcctcgcccgcatggccatctccggcgacgactgcgtcgtcaagcccctcgacgaccgcttcgcccgcgccctcaccgccctcaacgacatgggcaaggtccgcaaggacatccagcagtgggagccctccaagggctggtccgactggacccaggtccccttctgctcccaccacttccacgagctcatcatgaaggacggccgcaagctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcctcccacgagtggatgaccaccgaggacatgctcgccgtctggaaccgcgtctggatccaggacaacccctggatggaggacaagacccccgtcgagtcctgggaggacatcccctacctcggcaagcgcgaggaccagtggtgcggctccctcatcggcctcacctcccgcgccacctgggccaagaacatccagaccgccatcaaccaggtccgcgccctcatcggcgaggaggagtacatggactacatgccctccatgaagcgcttccgctccgaggaggaggagtccggcgtcctctggtga

SEQ ID NO: 12411 - RNA, 9876 nt, synthetic construct
  misc_feature 1..9876: note = derived and/or modified CDS sequence (opt2) from DENV-2__AF119661__SS-prME
  source 1..9876: mol_type = other RNA
accgtcggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcatcatcatggccgccatcctcgcctacaccatcggcaccacccacttccagcgcgccctcatcttcatcctcctcaccgccgtcgccccctccatgaccatgcgctgcatcggcgtctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgtcaccctccgcaagtactgcatcaaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccaccttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactgggtcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagtccctcgtcgactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccctccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctcgcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagaagggcatcctcggctactcccagatcggcaccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgccaacatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatggtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttcttcatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacaaccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggccgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12412 - RNA, 9876 nt, synthetic construct
  misc_feature 1..9876: note = derived and/or modified CDS sequence (opt2) from DENV-2__EU056810__SS-prME
  source 1..9876: mol_type = other RNA
accgccggcatcatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgaggtcgacttcaacttctgcgagggcaccaccgtcgtcgtcaccggcgactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcaccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12413 - RNA, 9876 nt, synthetic construct
  misc_feature 1..9876: note = derived and/or modified CDS sequence (opt2) from DENV-2__EU056811__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccaaggacggcaccaacatgtgcaccctcatggccatggacctcggcgagctctgcgaggacaccatcacctacaagtgccccttcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccatcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagcccaccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccgtcgtcatcaccccccactccggcgaggagcacgccgtcggcaacgacaccggcaagcacggcaaggaggtcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcgactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacctccgagctcaaccacatcctctccgagaacgaggtcaagctcaccatcatgaccggcgacatcaagggcatcatgcaggtcggcaagcgctccctccgcccccagcccaccgagctccgctactcctggaagacctggggcaaggccaagatgctctccaccgagctccacaaccagaccttcctcatcgacggccccgagaccgccgagtgccccaacaccaaccgcgcctggaactccctcgaggtcgaggactacggcttcggcgtcttcaccaccaacatctggctccgcctccgcgagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatggtcatccccaagaacatcgccggccccgtctcccagcacaacaaccgccccggctaccacacccagaccgccggcccctggcacctcggcaagctcgagatggacttcgacttctgcgagggcaccaccgtcgtcgtcaccgaggagtgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtctcctccctcgtcaccgccggccacggccagatcgacaacttctccctcggcatcctcggcatggccctcttcctcgaggagatgctccgcacccgcgtcggcaccaagcacgccatcctcctcgtcgccgtctccttcctcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtcctccatccccgagaccatcctcgagctcaccgacgccctcgccctcggcatgatggtcctcaagatggtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctcacccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggacgaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggccgcgccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttccgcaccaacaccggcaccatcggcgccgtctccctcgacttctcccccggcacctccggctcccccatcgtcgacaagaagggcaaggtcgtcggcctctacggcaacggcgtcgtcacccgcggcggcgcctacgtctccgccatcgcccagaccgagaagggcatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaagaccggcaacgacatcgccgcctgcctccgcaagaacggcaagcgcgtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaacccccgcaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcacccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcatcatcgccatcctcaccgtcgtcgccgccaccatggccaacgagatgggcttcctcgagaagaccaagaaggacctcggcctcggccacatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcatgctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccgtctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatgggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcgtcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcgtcaaggtcctcaacccctacatgccctccgtcatcgagcgcatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacaaccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccatcgaggacctcaagaacgaggagatgatcaccaaccacatggccggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgcctccgaggagatcgccgtccaggactggctcgtccgcgtcggccgcgagcgcctctcccgcatggccatctccggcgacgactgcgtcgtcaagcccctcgacgaccgcttcgccaaggccctcaccgccctcaacgacatgggcaaggtccgcaaggacatccagcagtgggagccctcccgcggctggaacgactggacccaggtccccttctgctcccaccacttccacgagctcatcatgaaggacggccgcaccctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcctcccacgagtggatgaccaccgaggacatgctcaccgtctggaaccgcgtctggatcctcgagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12414 - RNA, 9876 nt, synthetic construct
  misc_feature 1..9876: note = derived and/or modified CDS sequence (opt2) from DENV-2__DQ645545__SS-prME
  source 1..9876: mol_type = other RNA
accgccggcgtcatcatcatgatgatccccaccgtcgtcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctcccagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggcggcatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12415 - RNA, 9876 nt, synthetic construct
  misc_feature 1..9876: note = derived and/or modified CDS sequence (opt2) from DENV-2__DQ645546__SS-prME
  source 1..9876: mol_type = other RNA
accgccggcgtcatcatcatgatgatccccaccgtcgtcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggcggcatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12416 - RNA, 9876 nt, synthetic construct
  misc_feature 1..9876: note = derived and/or modified CDS sequence (opt2) from DENV-2__DQ645547__SS-prME
  source 1..9876: mol_type = other RNA
accgccggcgtcatcatcatgatgatccccaccgtcgtcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagtacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggcggcatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12417 - RNA, 9876 nt, synthetic construct
  misc_feature 1..9876: note = derived and/or modified CDS sequence (opt2) from DENV-2__DQ645549__SS-prME
  source 1..9876: mol_type = other RNA
accgccggcgtcatcatcatgatgatccccaccgtcgtcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggcggcatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggtcaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12418 - RNA, 9876 nt, synthetic construct
  misc_feature 1..9876: note = derived and/or modified CDS sequence (opt2) from DENV-2__DQ645550__SS-prME
  source 1..9876: mol_type = other RNA
accgccggcgtcatcatcatgatgatccccaccgtcgtcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggcggcatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcctctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggtcaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12419 - RNA, 9876 nt, synthetic construct
  misc_feature 1..9876: note = derived and/or modified CDS sequence (opt2) from DENV-2__DQ645551__SS-prME
  source 1..9876: mol_type = other RNA
accgccggcgtcatcatcatgatgatccccaccgtcgtcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacaccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggcggcatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12420 - RNA, 9876 nt, synthetic construct
  misc_feature 1..9876: note = derived and/or modified CDS sequence (opt2) from DENV-2__DQ645552__SS-prME
  source 1..9876: mol_type = other RNA
accgccggcgtcatcatcatgatgatccccaccgtcgtcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggcggcatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccacctcccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12421 - RNA, 9876 nt, synthetic construct
  misc_feature 1..9876: note = derived and/or modified CDS sequence (opt2) from DENV-2__DQ645553__SS-prME
  source 1..9876: mol_type = other RNA
accgccggcgtcatcatcatgatgatccccaccgtcgtcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctcccccggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggcggcatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcgccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12422 - RNA, 9876 nt, synthetic construct
  misc_feature 1..9876: note = derived and/or modified CDS sequence (opt2) from DENV-2__DQ645554__SS-prME
  source 1..9876: mol_type = other RNA
accgccggcgtcatcatcatgatgatccccaccgtcgtcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggcggcatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12423 - RNA, 9876 nt, synthetic construct
  misc_feature 1..9876: note = derived and/or modified CDS sequence (opt2) from DENV-2__DQ645555__SS-prME
  source 1..9876: mol_type = other RNA
accgccggcgtcatcatcatgatgatccccaccgtcgtcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctcccagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggcggcatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12424 - RNA, 9876 nt, synthetic construct
  misc_feature 1..9876: note = derived and/or modified CDS sequence (opt2) from DENV-2__DQ645556__SS-prME
  source 1..9876: mol_type = other RNA
accgccggcgtcatcatcatgatgatccccaccgtcgtcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggcggcatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagaacatccagcagctcaccgccaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacgtccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12425 - RNA, 9876 nt, synthetic construct
  misc_feature 1..9876: note = derived and/or modified CDS sequence (opt2) from DENV-2__AF204178__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccggcgacggcgtcaacatgtgcaccctcatggccatggaccccggcgagctctgcgaggacaccatcacctacaagtgccccctcctcaagcagaacgagcccgaggacatcgactggtggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatgatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagccctccctcaacgaggagcaggacaagcgcttcgtctgcaagcactccatggtcgaccgcggctggggcaacggctgcggcctcttcggcaagggcggcatcgtcaccttcgccatgttcacctgcaagaagaacatgaagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatgaagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacgacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgtcatcaaggacaaccgcgccgcccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacgcctggaaggtctcctgcaccatcctcgccgtcgtctccgtctcccccctcttcatcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagatcctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgccaagatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagatccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtcggcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctctacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtccgccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12426 - RNA, 9876 nt, synthetic construct
  misc_feature 1..9876: note = derived and/or modified CDS sequence (opt2) from DENV-2__AF204177__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccggcgacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacctcgagctcatcaagaccgaggccaagcagtccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatgaagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacgaggtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtgctgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacgcctggaaggtctcctgcaccatcctcgccgtcgtctccgtctcccccctcttcctcacctcctcccagcagaaggccgactggatccccctcgccctcaccatcaagggcctcaaccccaccgccatcttcctcaccaccctctccaagaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagatcctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacgccggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagcgcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagaccctctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagcgcaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccagaacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacctccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12427 - RNA, 9876 nt, synthetic construct
  misc_feature 1..9876: note = derived and/or modified CDS sequence (opt2) from DENV-2__DQ645540__SS-prME
  source 1..9876: mol_type = other RNA
accgccggcgtcatcatcatgatgatccccaccgtcgtcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcaccaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggcggcatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggtcaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12428 - RNA, 9876 nt, synthetic construct
  misc_feature 1..9876: note = derived and/or modified CDS sequence (opt2) from DENV-2__DQ645541__SS-prME
  source 1..9876: mol_type = other RNA
accgccggcgtcatcatcatgatgatccccaccgtcgtcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcaccaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggcggcatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12429 - RNA, 9876 nt, synthetic construct
  misc_feature 1..9876: note = derived and/or modified CDS sequence (opt2) from DENV-2__DQ645542__SS-prME
  source 1..9876: mol_type = other RNA
accgccggcgtcatcatcatgatgatccccaccgtcgtcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcaccaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggcggcatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12430 - RNA, 9876 nt, synthetic construct
  misc_feature 1..9876: note = derived and/or modified CDS sequence (opt2) from DENV-2__AY702036__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatgcccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaaccgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctcctccctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12431 - RNA, 9876 nt, synthetic construct
  misc_feature 1..9876: note = derived and/or modified CDS sequence (opt2) from DENV-2__AY702034__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatgcccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaaccgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctcctccctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12432 - RNA, 9876 nt, synthetic construct
  misc_feature 1..9876: note = derived and/or modified CDS sequence (opt2) from DENV-2__AF208496__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccttcctccgccagaacgagcccgaggacatcgactgctggtgcaacttcacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatgcccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctcctccctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccacaagcgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12433 - RNA, 9876 nt, synthetic construct
  misc_feature 1..9876: note = derived and/or modified CDS sequence (opt2) from DENV-2__AY702040__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccaaggacggcaccaacatgtgcaccctcatggccatggacctcggcgagctctgcgaggacaccatcacctacaagtgccccttcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccatcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagcccaccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccgtcgtcatcaccccccactccggcgaggagcacgccgtcggcaacgacaccggcaagcacggcaaggaggtcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcgactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacctccgagctcaaccacatcctctccgagaacgaggtcaagctcaccatcatgaccggcgacatcaagggcatcatgcaggtcggcaagcgctccctccgcccccagcccaccgagctccgctactcctggaagacctggggcaaggccaagatgctctccaccgagctccacaaccagaccttcctcatcgacggccccgagaccgccgagtgccccaacaccaaccgcgcctggaactccctcgaggtcgaggactacggcttcggcgtcttcaccaccaacatctggctccgcctccgcgagaagcaggacgccttctgcgaccccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatggtcatccccaagaacttcgccggccccgtctcccagcacaacaaccgccccggctaccacacccagaccgccggcccctggcacctcggcaagctcgagatggacttcgacttctgcgagggcaccaccgtcgtcgtcaccgaggagtgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtctcctccctcgtcaccgccggccacggccagatcgacaacttctccctcggcatcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtcctccatccccgagaccatcctcgagctcaccgacgccctcgccctcggcatgatggtcctcaagatggtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggacgaccaggccgagatctccggctcctcccccatcctctccatcatcatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggccgcgccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttccgcaccaacaccggcaccatcggcgccgtctccctcgacttctcccccggcacctccggctcccccatcgtcgacaagaagggcaaggtcgtcggcctctacggcaacggcgtcgtcacccgcggcggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaagaccggcaacgacatcgccgcctgcctccgcaagaacggcaagcgcgtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaacccccgcaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcacccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcatcatcgccatcctcaccgtcgtcgccgccaccatggccaacgagatgggcttcctcgagaagaccaagaaggacttcggcctcggccacatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccgtctccaccctctgggagggcaaccccggccgcttctggaacaccaccatcgccgtctccatggccaacatcttccgcggctcctacctcgccggcgccggcctcctcttctccatcatgaagaacaccacctccgcccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcgtcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcgtcaaggtcctcaacccctacatgccctccgtcatcgagcgcatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacaaccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccatcgaggacctcaagaacgaggagatgatcaccaaccacatggccggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgcctccgaggagatcgccgtccaggactggctcgtccgcgtcggccgcgagcgcctctcccgcatggccatctccggcgacgactgcgtcgtcaagcccctcgacgaccgcttcgccaaggccctcaccgccctcaacgacatgggcaaggtccgcaaggacatccagcagtgggagccctcccgcggctggaacgactggacccaggtccccttctgctcccaccacttccacgagctcatcatgaaggacggccgcaccctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcctcccacgagtggatgaccaccgaggacatgctcaccgtctggaaccgcgtctggatcctcgagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12434 - RNA, 9876 nt, synthetic construct
  misc_feature 1..9876: note = derived and/or modified CDS sequence (opt2) from DENV-2__AY037116__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgcggctgccactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcgtcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgcctgggccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgcctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacatcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12435 - RNA, 9876 nt, synthetic construct
  misc_feature 1..9876: note = derived and/or modified CDS sequence (opt2) from DENV-2__AF169678__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcatcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatccagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatgatcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12436 - RNA, 9876 nt, synthetic construct
  misc_feature 1..9876: note = derived and/or modified CDS sequence (opt2) from DENV-2__AF169679__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccaagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcatcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatgatcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12437 - RNA, 9876 nt, synthetic construct
  misc_feature 1..9876: note = derived and/or modified CDS sequence (opt2) from DENV-2__AF169680__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcatcatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaacttcctcatcgacggccccgagaccgccgagtgccccaacaccaaccgcgcctggaactccctcgaggtcgaggactacggcttcggcgtcttcaccaccaacgtctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcatcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggagcgccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagatgaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaacccctccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacaccgtctcccgcggctccgccaagctccgctggttcgtcgagcgcaacatgatcacccccgagggcaaggtcctcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12438 - RNA, 9876 nt, synthetic construct
  misc_feature 1..9876: note = derived and/or modified CDS sequence (opt2) from DENV-2__AF169682__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgccgcatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcatcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctccccctccctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcgccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgtcttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggagatcgccgtccagaactgcctcgcccgcctcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12439 - RNA, 9876 nt, synthetic construct
  misc_feature 1..9876: note = derived and/or modified CDS sequence (opt2) from DENV-2__AF169681__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgccgcatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccaagaccgccgagtgccccaacaccaaccgcgcctggaactccctcgaggtcgaggactacggcttcggcgtcttcaccaccaacatctggctcaagctcaaggagaagcaggacgccctctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcatcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggagaaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcgccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgtcttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctccgctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12440 - RNA, 9876 nt, synthetic construct
  misc_feature 1..9876: note = derived and/or modified CDS sequence (opt2) from DENV-2__AF169683__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgccgcatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcacgccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcatcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccacttctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcgccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgtcttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagtcccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcatcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcctcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12441 - RNA, 9876 nt, synthetic construct
  misc_feature 1..9876: note = derived and/or modified CDS sequence (opt2) from DENV-2__AF169684__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgccgcatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcatcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctcccgctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagaagtacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccacttctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcgccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcttcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgccgctacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12442 - RNA, 9876 nt, synthetic construct
  misc_feature 1..9876: note = derived and/or modified CDS sequence (opt2) from DENV-2__AF169685__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgccgcatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcatcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccacttctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcgccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgtcttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgccgctacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12443 - RNA, 9876 nt, synthetic construct
  misc_feature 1..9876: note = derived and/or modified CDS sequence (opt2) from DENV-2__AF169686__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgccgcatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcttcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcatcctcacctcctcccagcagaagaccgactggatccccctcgccctcaccatcaagggcctcaaccccaccgccatcttcctcaccaccctctcccgcaccaacaagaagcgctcctggcccgtcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagaagtacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccacttctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcgccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgtcttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgccgctacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgagaccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12444 - RNA, 9876 nt, synthetic construct
  misc_feature 1..9876: note = derived and/or modified CDS sequence (opt2) from DENV-2__AF169687__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgccgcatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcacgccggcaagcgctccctccgcccccagcccaccgagctcaagtactcctggaagacctggggcatcgccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcaccgtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcatcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccacttctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcgccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgtcttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctccggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggctcccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12445 - RNA, 9876 nt, synthetic construct
  misc_feature 1..9876: note = derived and/or modified CDS sequence (opt2) from DENV-2__AF169688__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagacctcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgccgcatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcacgccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcatcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccacttctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcgccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgtcttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcaagaccctcggcgagaagtggaagtcccgcctcaacgccctcggcaagatcgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12446 - RNA, 9873 nt, synthetic construct
  misc_feature 1..9873: note = derived and/or modified CDS sequence (opt2) from DENV-3__AB189125__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcatcctcgagcagggcaagcgcaccctcaccccccagcccatggagctcaagtactcctggaagacctggggcaaggccaagatcgtcaccgccgagatccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagccctcctgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacgtcgacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgtcatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgctcccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12447 - RNA, 9873 nt, synthetic construct
  misc_feature 1..9873: note = derived and/or modified CDS sequence (opt2) from DENV-3__AB189126__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaaggtcgtcaccgccgagatccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcatcctcttcatcttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtcccccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagctcgagggcgccatctggtga

SEQ ID NO: 12448 - RNA, 9873 nt, synthetic construct
  misc_feature 1..9873: note = derived and/or modified CDS sequence (opt2) from DENV-3__AB189127__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaaggtcgtcaccgccgagatccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccatccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcatcctcttcatgttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagccctcctgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtcccccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagctcgagggcgccatctggtga

SEQ ID NO: 12449 - RNA, 9873 nt, synthetic construct
  misc_feature 1..9873: note = derived and/or modified CDS sequence (opt2) from DENV-3__AB189128__SS-prME
  source 1..9873: mol_type = other RNA
acctccctctgcctcatgatgatcctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccgtcctcgccctcttcctcgcccacttcatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccaccgagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggagtacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccaacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggacggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccatctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcatcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaagatcacccagtggctcgaggccgagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggccacacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12450 - RNA, 9873 nt, synthetic construct
  misc_feature 1..9873: note = derived and/or modified CDS sequence (opt2) from DENV-3__AB214879__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccgtcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcacctccctcatgtgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagtccggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccttcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagcgcatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12451 - RNA, 9873 nt, synthetic construct
  misc_feature 1..9873: note = derived and/or modified CDS sequence (opt2) from DENV-3__AB214880__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgcctccctcatgtgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagtccggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccttcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagcgcatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12452 - RNA, 9873 nt, synthetic construct
  misc_feature 1..9873: note = derived and/or modified CDS sequence (opt2) from DENV-3__AB214881__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcatcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgcctccctcatgtgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagtccggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccttcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagcgcatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagctcgagggcgccatctggtga

SEQ ID NO: 12453 - RNA, 9873 nt, synthetic construct
  misc_feature 1..9873: note = derived and/or modified CDS sequence (opt2) from DENV-3__AB214882__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcaccggcatcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgcctccctcatgtgctccaacaccatcttcaccctcaccgtcgcctggcgcaccgccaccctcatcctcgccggcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagtccggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccttcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagcgcatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12454 - RNA, 9873 nt, synthetic construct
  misc_feature 1..9873: note = derived and/or modified CDS sequence (opt2) from DENV-3__JX669489__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatcgccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12455 - RNA, 9873 nt, synthetic construct
  misc_feature 1..9873: note = derived and/or modified CDS sequence (opt2) from DENV-3__JX669498__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcaccggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcggcaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12456 - RNA, 9873 nt, synthetic construct
  misc_feature 1..9873: note = derived and/or modified CDS sequence (opt2) from DENV-3__KF954946__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccatcctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcatcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgtcggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatgctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggacggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccatggccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcctcggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaagaccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccatccccgtccactgggtccccacctcccgcaccacctggtccatccacgcccaccaccagtggatgaccaccgaggacatgctcaccgtctggaaccgcgtctggatcgaggacaacccctggatggaggacaagacccccatcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12457 - RNA, 9873 nt, synthetic construct
  misc_feature 1..9873: note = derived and/or modified CDS sequence (opt2) from DENV-3__KF954947__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcatcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgtcggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatgctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggacggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccatggccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcgcatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaagaccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccatccccgtccactgggtccccacctcccgcaccacctggtccatccacgcccaccaccagtggatgaccaccgaggacatgctcaccgtctggaaccgcgtctggatcgaggacaacccctggatggaggacaagacccccatcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12458 - RNA, 9873 nt, synthetic construct
  misc_feature 1..9873: note = derived and/or modified CDS sequence (opt2) from DENV-3__KF954945__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccatcctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcatcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgtcggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatgctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggacggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccatggccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaagaccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccatccccgtccactgggtccccacctcccgcaccacctggtccatccacgcccaccaccagtggatgaccaccgaggacatgctcaccgtctggaaccgcgtctggatcgaggacaacccctggatggaggacaagacccccatcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12459 - RNA, 9873 nt, synthetic construct
  misc_feature 1..9873: note = derived and/or modified CDS sequence (opt2) from DENV-3__JX669495__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12460 - RNA, 9873 nt, synthetic construct
  misc_feature 1..9873: note = derived and/or modified CDS sequence (opt2) from DENV-3__JX669499__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcatcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12461 - RNA, 9873 nt, synthetic construct
  misc_feature 1..9873: note = derived and/or modified CDS sequence (opt2) from DENV-3__JX669492__SS-prME
  source 1..9873: mol_type = other RNA
acctccttctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12462 - RNA, 9873 nt, synthetic construct
  misc_feature 1..9873: note = derived and/or modified CDS sequence (opt2) from DENV-3__JX669500__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12463 - RNA, 9873 nt, synthetic construct
  misc_feature 1..9873: note = derived and/or modified CDS sequence (opt2) from DENV-3__JX669497__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgcctccaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12464 - RNA, 9873 nt, synthetic construct
  misc_feature 1..9873: note = derived and/or modified CDS sequence (opt2) from DENV-3__JX669501__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcgtcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcaccatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccatggaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatgtacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12465 - RNA, 9873 nt, synthetic construct
  misc_feature 1..9873: note = derived and/or modified CDS sequence (opt2) from DENV-3__JX669494__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcaccaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacaccgtctcccgcctcctcctcaaccgcttcaccatgacccaccgccgccccaccaccgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12466 - RNA, 9873 nt, synthetic construct
  misc_feature 1..9873: note = derived and/or modified CDS sequence (opt2) from DENV-3__JX669503__SS-prME
  source 1..9873: mol_type = other RNA
acctccttctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcgtcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12467 - RNA, 9873 nt, synthetic construct
  misc_feature 1..9873: note = derived and/or modified CDS sequence (opt2) from DENV-3__JX669493__SS-prME
  source 1..9873: mol_type = other RNA
acctccttctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatcggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12468 - RNA, 9873 nt, synthetic construct
  misc_feature 1..9873: note = derived and/or modified CDS sequence (opt2) from DENV-3__JX669504__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcaccaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccctcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacaccgtctcccgcctcctcctcaaccgcttcaccatgacccaccgccgccccaccaccgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12469 - RNA, 9873 nt, synthetic construct
  misc_feature 1..9873: note = derived and/or modified CDS sequence (opt2) from DENV-3__JX669506__SS-prME
  source 1..9873: mol_type = other RNA
acctccttctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcctacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12470 - RNA, 9873 nt, synthetic construct
  misc_feature 1..9873: note = derived and/or modified CDS sequence (opt2) from DENV-3__JX669496__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcaccaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcgccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacaccgtctcccgcctcctcctcaaccgcttcaccatgacccaccgccgccccaccaccgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12471 - RNA, 9873 nt, synthetic construct
  misc_feature 1..9873: note = derived and/or modified CDS sequence (opt2) from DENV-3__JX669490__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12472 - RNA, 9873 nt, synthetic construct
  misc_feature 1..9873: note = derived and/or modified CDS sequence (opt2) from DENV-3__JN406515__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacgagcagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacgtcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccggcatctccctcttccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatgatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaaggcccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12473 - RNA, 9873 nt, synthetic construct
  misc_feature 1..9873: note = derived and/or modified CDS sequence (opt2) from DENV-3__JN406514__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcctcgacctccccctcccctggacctccggcgccaccaccgagcgccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttctccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcatctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcacaagcagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12474 - RNA, 9873 nt, synthetic construct
  misc_feature 1..9873: note = derived and/or modified CDS sequence (opt2) from DENV-3__KT726340__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcatcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcgtcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccgcctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccatcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12475 - RNA, 9873 nt, synthetic construct
  misc_feature 1..9873: note = derived and/or modified CDS sequence (opt2) from DENV-3__KT726345__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcatctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12476 - RNA, 9873 nt, synthetic construct
  misc_feature 1..9873: note = derived and/or modified CDS sequence (opt2) from DENV-3__KT726349__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagtccatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12477 - RNA, 9873 nt, synthetic construct
  misc_feature 1..9873: note = derived and/or modified CDS sequence (opt2) from DENV-3__KT726347__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcgccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12478 - RNA, 9873 nt, synthetic construct
  misc_feature 1..9873: note = derived and/or modified CDS sequence (opt2) from DENV-3__KT726352__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccgccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12479 - RNA, 9873 nt, synthetic construct
  misc_feature 1..9873: note = derived and/or modified CDS sequence (opt2) from DENV-3__KT726356__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcctcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12480 - RNA, 9873 nt, synthetic construct
  misc_feature 1..9873: note = derived and/or modified CDS sequence (opt2) from DENV-3__KT726342__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12481 - RNA, 9873 nt, synthetic construct
  misc_feature 1..9873: note = derived and/or modified CDS sequence (opt2) from DENV-3__KT726343__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12482 - RNA, 9873 nt, synthetic construct
  misc_feature 1..9873: note = derived and/or modified CDS sequence (opt2) from DENV-3__KT726351__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgcaaggtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12483 - RNA, 9873 nt, synthetic construct
  misc_feature 1..9873: note = derived and/or modified CDS sequence (opt2) from DENV-3__KT726360__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggaccccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12484 - RNA, 9873 nt, synthetic construct
  misc_feature 1..9873: note = derived and/or modified CDS sequence (opt2) from DENV-3__KF041259__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaacgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggccgcctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagcgcaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaagatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagctcgagggcgccatctggtga

SEQ ID NO: 12485 - RNA, 9873 nt, synthetic construct
  misc_feature 1..9873: note = derived and/or modified CDS sequence (opt2) from DENV-3__KF041258__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatgacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagcgcaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacgtcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagctcgagggcgccatctggtga

SEQ ID NO: 12486 - RNA, 9873 nt, synthetic construct
  misc_feature 1..9873: note = derived and/or modified CDS sequence (opt2) from DENV-3__KF041257__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagcgcaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctccgcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagctcgagggcgccatctggtga

SEQ ID NO: 12487 - RNA, 9873 nt, synthetic construct
  misc_feature 1..9873: note = derived and/or modified CDS sequence (opt2) from DENV-3__KF041255__SS-prME
  source 1..9873: mol_type = other RNA
acctccctctgcctcatgatgatcctccccgccgccctcgccttccacctcacctcccgcaacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagcgcaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaagatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagctcgagggcgccatctggtga

SEQ ID NO: 12488 - RNA, 9873 nt, synthetic construct
  misc_feature 1..9873: note = derived and/or modified CDS sequence (opt2) from DENV-3__KF041256__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccctcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagcgcaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgagaagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaagatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccatccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagctcgagggcgccatctggtga

SEQ ID NO: 12489 - RNA, 9873 nt, synthetic construct
  misc_feature 1..9873: note = derived and/or modified CDS sequence (opt2) from DENV-3__KF041254__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgtcgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggcgcacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagcgcaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccaccctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgcccgcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctccaagctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagctcgagggcgccatctggtga

SEQ ID NO: 12490 - RNA, 9873 nt, synthetic construct
  misc_feature 1..9873: note = derived and/or modified CDS sequence (opt2) from DENV-3__KX380841__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcatcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggacggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccatggccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaagaccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccatcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12491 - RNA, 9873 nt, synthetic construct
  misc_feature 1..9873: note = derived and/or modified CDS sequence (opt2) from DENV-3__KX380842__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcatcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgtcggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatgctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggacggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccatggccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaagaccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccatccccgtccactgggtccccacctcccgcaccacctggtccatccacgcccaccaccagtggatgaccaccgaggacatgctcaccgtctggaaccgcgtctggatcgaggacaacccctggatggaggacaagacccccatcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12492 - RNA, 9873 nt, synthetic construct
  misc_feature 1..9873: note = derived and/or modified CDS sequence (opt2) from DENV-3__KX380839__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccatcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagctcaccgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcttccgctcctacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcatcctcgagcagggcaagcgcaccctcaccccccagcccatggagctcaagtactcctggaagacctggggcaaggccaagatcgtcaccgccgagacccagaactcctccttcatcatcgacggccccaacacccccgagtgccccaacgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctgggccgccctcgtctccctcatgtgctccaacaccatcttcaccctcaccgtcgcctggcgcaccgccaccctcatcctcgccggcatctccctcctccccatgtgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccccccacctcgcccaccgcacccgcaacgccctcgacaacctcgtcatgctccacacctccgagtacggcggccgcgcctaccgccacgccgtcgaggagctccccgagaccatggagaccctcctcctcctcggcctcatgatcctcctcaccggcggcgtcatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatctccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatgatctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12493 - RNA, 9873 nt, synthetic construct
  misc_feature 1..9873: note = derived and/or modified CDS sequence (opt2) from DENV-3__KX380840__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccatcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcgcccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagctcaccgagggcaaggtcgtccagcacgagaacctcaagtacaccgtcatcatcaccgtccacaccggcgaccagcaccaggtcggcaacgagacccagggcgtcaccgccgagatcaccccccaggcctccaccgtcgaggccatcttccgctcctacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgctccaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcatcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcatcctcgagcagggcaagcgcaccctcaccccccagcccatggagctcaagtactcctggaagacctggggcaaggccaagatcgtcaccgccgagacccagaactcctccttcatcatcgacggccccaacacccccgagtgccccaacgccctccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctgggccgccctcgtctccctcatgtgctccaacaccatcttcaccctcaccgtcgcctggcgcaccgccaccctcatcctcgccggcatctccctcctccccatgtgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggcaaggagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgactggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccccccacctcgcccaccgcacccgcaacgccctcgacaacctcgtcatgctccacacctccgagtacggcggccgcgcctaccgccacgccgtcgaggagctccccgagaccatggagaccctcctcctcctcggcctcatgatcctcctcaccggcggcgtcatgctcttcctcatctccggcaagggcgtcggcaagacctccatcggcctcatctgcgtcgtcgcctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatctccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatgatctcccgcctcctcctcaaccgcttcaccatgacctaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccaccgtcacccagatggccatgaccgacaccacccccttcggccagcagcgcgtcttcaaggagaaggtcgacacccgcacccccaagcccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaagaccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12494 - RNA, 9873 nt, synthetic construct
  misc_feature 1..9873: note = derived and/or modified CDS sequence (opt2) from DENV-3__JF808121__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcaccaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttctccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcaccggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcaccatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggatcgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgaagcaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggaagaccctcggccgcaacaagaagccccgcctctgcccccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggctccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcatgacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12495 - RNA, 9873 nt, synthetic construct
  misc_feature 1..9873: note = derived and/or modified CDS sequence (opt2) from DENV-3__JF808120__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcaccggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcaagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcaacctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcatcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgaccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggctccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12496 - RNA, 9873 nt, synthetic construct
  misc_feature 1..9873: note = derived and/or modified CDS sequence (opt2) from DENV-3__JF808119__SS-prME
  source 1..9873: mol_type = other RNA
acctccctctgcctcatgatgatcctccccaccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggacgagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcaggtcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcatgttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcatcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaagatcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgaggactgcgtcctcaagcccatcgacgaccgcttcgacaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgccctccaccagtggatgaccaccgaggacatgatcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12497 - RNA, 9873 nt, synthetic construct
  misc_feature 1..9873: note = derived and/or modified CDS sequence (opt2) from DENV-3__JF808118__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccatcctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12498 - RNA, 9873 nt, synthetic construct
  misc_feature 1..9873: note = derived and/or modified CDS sequence (opt2) from DENV-3__JF808127__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccctcaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcaccggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccgagcccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctcaacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaagatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagcccaagctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12499 - RNA, 9873 nt, synthetic construct
  misc_feature 1..9873: note = derived and/or modified CDS sequence (opt2) from DENV-3__JF808124__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccttcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagctcgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcaggtcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcacctgcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatgggcaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcctctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcggcgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcatctacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgtcctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12500 - RNA, 9873 nt, synthetic construct
  misc_feature 1..9873: note = derived and/or modified CDS sequence (opt2) from DENV-3__JF808126__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcaccctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcctcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaagtccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggccccgccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctgccccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcgtctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccagaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgccgctggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctcccctggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12501 - RNA, 9873 nt, synthetic construct
  misc_feature 1..9873: note = derived and/or modified CDS sequence (opt2) from DENV-3__JF808125__SS-prME
  source 1..9873: mol_type = other RNA
acctccctctgcctcatgatgatcctccccgccgccctcgccttccacctcacctcccgcgacggcgagccccgcatgatcgtcggcgagaacgagcgcggcaagtccctcctcttcaagaccgcctccggcatcaaccgccgcaccctcatcgccatggacctcggcgagatgtgcgaggagaccgagacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccgccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctccggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctccgcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12502 - RNA, 9873 nt, synthetic construct
  misc_feature 1..9873: note = derived and/or modified CDS sequence (opt2) from DENV-3__JF808129__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcaccggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaactgcaccatgggcgtcctctgcctcgccatcctcttcgaggacgtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgaccaccgtcgacgacgacggcaccatgcgcatcaaggacgacgagaccgagaacatcctcaccgtcctcctcaagaccgccctcaccatcgtctccggcgtcttcccctactccatccccgccaccctcctcgtctggcacacctggcagaagcagacccagcgctccggcgtcctctgggacgtcccctccccccccgagacccagaaggccgagcaggaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccacctacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcaccaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12503 - RNA, 9873 nt, synthetic construct
  misc_feature 1..9873: note = derived and/or modified CDS sequence (opt2) from DENV-3__JF808123__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccacctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcggccccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcaccggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12504 - RNA, 9873 nt, synthetic construct
  misc_feature 1..9873: note = derived and/or modified CDS sequence (opt2) from DENV-3__JF808128__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagcgcaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcctcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaagtccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggccccgccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcgtctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgccgctggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcccgctccatgtcctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12505 - RNA, 9873 nt, synthetic construct
  misc_feature 1..9873: note = derived and/or modified CDS sequence (opt2) from DENV-3__JF808122__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcatcaagtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccccccacctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcaccggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgtcctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaacggctcccgcgccatctggtacatgtggctcggcgcccgctacctcgagttcgaggccctcggcttcctcaaggagtaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacaccggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12506 - RNA, 9873 nt, synthetic construct
  misc_feature 1..9873: note = derived and/or modified CDS sequence (opt2) from DENV-3__GQ466079__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactccttcttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcgagaacctcgagctcgacttcacctactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcatcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgtccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggctcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggctcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12507 - RNA, 9873 nt, synthetic construct
  misc_feature 1..9873: note = derived and/or modified CDS sequence (opt2) from DENV-3__FJ898462__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagcgcggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccatcgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12508 - RNA, 9873 nt, synthetic construct
  misc_feature 1..9873: note = derived and/or modified CDS sequence (opt2) from DENV-3__KF955473__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccatcctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12509 - RNA, 9873 nt, synthetic construct
  misc_feature 1..9873: note = derived and/or modified CDS sequence (opt2) from DENV-3__FJ850079__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacgtcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcaccggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacgactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12510 - RNA, 9873 nt, synthetic construct
  misc_feature 1..9873: note = derived and/or modified CDS sequence (opt2) from DENV-3__FJ850080__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggacgagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcaggtcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcatgttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcatcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaagatcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12511 - RNA, 9873 nt, synthetic construct
  misc_feature 1..9873: note = derived and/or modified CDS sequence (opt2) from DENV-3__FJ850083__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagcgcgaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggacgagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcaccatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaagatcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12512 - RNA, 9873 nt, synthetic construct
  misc_feature 1..9873: note = derived and/or modified CDS sequence (opt2) from DENV-3__FJ850086__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcgccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggacgagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagaccgtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcaggtcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcatgttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcatcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaagatcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12513 - RNA, 9873 nt, synthetic construct
  misc_feature 1..9873: note = derived and/or modified CDS sequence (opt2) from DENV-3__FJ850089__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggtcatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggacgagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaaggtcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccagatcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaagatcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12514 - RNA, 9873 nt, synthetic construct
  misc_feature 1..9873: note = derived and/or modified CDS sequence (opt2) from DENV-3__FJ850092__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggtcatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgtcaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggacgagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaaggtcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcatcgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaagatcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12515 - RNA, 9873 nt, synthetic construct
  misc_feature 1..9873: note = derived and/or modified CDS sequence (opt2) from DENV-3__FJ850094__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccggcacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggacgagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcgtcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccttcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacggcatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaagatcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12516 - RNA, 9873 nt, synthetic construct
  misc_feature 1..9873: note = derived and/or modified CDS sequence (opt2) from DENV-3__FJ898446__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcaccggcgacaacgccctcaagatcaactggtacaagaagggctcctccatcggcaagatgttcgagaccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12517 - RNA, 9873 nt, synthetic construct
  misc_feature 1..9873: note = derived and/or modified CDS sequence (opt2) from DENV-3__GU131844__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcaccggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacgtcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgcccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcgcccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggctccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcgccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12518 - RNA, 9873 nt, synthetic construct
  misc_feature 1..9873: note = derived and/or modified CDS sequence (opt2) from DENV-3__GU131849__SS-prME
  source 1..9873: mol_type = other RNA
acctccctctgcctcgtcatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccatcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccatgctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccacccccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaactcccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12519 - RNA, 9873 nt, synthetic construct
  misc_feature 1..9873: note = derived and/or modified CDS sequence (opt2) from DENV-3__GQ868546__SS-prME
  source 1..9873: mol_type = other RNA
acctccctctgcctcgtcatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccacccccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12520 - RNA, 9873 nt, synthetic construct
  misc_feature 1..9873: note = derived and/or modified CDS sequence (opt2) from DENV-3__GU131850__SS-prME
  source 1..9873: mol_type = other RNA
acctccctctgcctcgtcatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcatcaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatcggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccaactcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagaagggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12521 - RNA, 9873 nt, synthetic construct
  misc_feature 1..9873: note = derived and/or modified CDS sequence (opt2) from DENV-3__GU131851__SS-prME
  source 1..9873: mol_type = other RNA
acctccctctgcctcgtcatgatcctccccgccgccctcgccttccacctcacctcccgcgacggcgagccccacatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggctcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccacccccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12522 - RNA, 9873 nt, synthetic construct
  misc_feature 1..9873: note = derived and/or modified CDS sequence (opt2) from DENV-3__GQ868547__SS-prME
  source 1..9873: mol_type = other RNA
acctccctctgcctcgtcatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatggtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtccacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccacccccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12523 - RNA, 9873 nt, synthetic construct
  misc_feature 1..9873: note = derived and/or modified CDS sequence (opt2) from DENV-3__GU131857__SS-prME
  source 1..9873: mol_type = other RNA
acctccctctgcctcgtcatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccacccccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12524 - RNA, 9873 nt, synthetic construct
  misc_feature 1..9873: note = derived and/or modified CDS sequence (opt2) from DENV-3__GU131858__SS-prME
  source 1..9873: mol_type = other RNA
acctccctctgcctcgtcatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcatcaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatcggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacctccggcccctccctcaccaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccaactcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12525 - RNA, 9873 nt, synthetic construct
  misc_feature 1..9873: note = derived and/or modified CDS sequence (opt2) from DENV-3__GQ868548__SS-prME
  source 1..9873: mol_type = other RNA
acctccctctgcctcgtcatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccacccccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12526 - RNA, 9873 nt, synthetic construct
  misc_feature 1..9873: note = derived and/or modified CDS sequence (opt2) from DENV-3__GU131861__SS-prME
  source 1..9873: mol_type = other RNA
acctccctctgcctcgtcatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccacccccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgtcaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccgtcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagcgcaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagaagatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12527 - RNA, 9873 nt, synthetic construct
  misc_feature 1..9873: note = derived and/or modified CDS sequence (opt2) from DENV-3__GU131862__SS-prME
  source 1..9873: mol_type = other RNA
acctccctctgcctcgtcatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcatcaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatcggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcaccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccaactcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggaagaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12528 - RNA, 9873 nt, synthetic construct
  misc_feature 1..9873: note = derived and/or modified CDS sequence (opt2) from DENV-3__GU131865__SS-prME
  source 1..9873: mol_type = other RNA
acctccctctgcctcgtcatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccacccccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgtcaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccgtcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagcgcaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgaccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggtccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12529 - RNA, 9873 nt, synthetic construct
  misc_feature 1..9873: note = derived and/or modified CDS sequence (opt2) from DENV-3__GU131866__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgaccgccgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacgcctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcaagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12530 - RNA, 9873 nt, synthetic construct
  misc_feature 1..9873: note = derived and/or modified CDS sequence (opt2) from DENV-3__GU131868__SS-prME
  source 1..9873: mol_type = other RNA
acccccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaacaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaaggccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggcctccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagccctccgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcttcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12531 - RNA, 9873 nt, synthetic construct
  misc_feature 1..9873: note = derived and/or modified CDS sequence (opt2) from DENV-3__GU131869__SS-prME
  source 1..9873: mol_type = other RNA
acctccctctgcctcgtcatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacatcgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccacccccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccacccgctccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12532 - RNA, 9873 nt, synthetic construct
  misc_feature 1..9873: note = derived and/or modified CDS sequence (opt2) from DENV-3__GU131870__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaaccacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcatcgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcgtcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12533 - RNA, 9873 nt, synthetic construct
  misc_feature 1..9873: note = derived and/or modified CDS sequence (opt2) from DENV-3__GU131871__SS-prME
  source 1..9873: mol_type = other RNA
acctccctctgcctcgtcatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggaccaccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccacccccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagcgcaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12534 - RNA, 9873 nt, synthetic construct
  misc_feature 1..9873: note = derived and/or modified CDS sequence (opt2) from DENV-3__GU131872__SS-prME
  source 1..9873: mol_type = other RNA
acctccctctgcctcgtcatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatggtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccacccccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12535 - RNA, 9873 nt, synthetic construct
  misc_feature 1..9873: note = derived and/or modified CDS sequence (opt2) from DENV-3__GU131873__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagtacgagaacctcaagtacaccgtcgtcatcaccgtccacaccggcgaccagcaccaggtcggcaacgagacccagggcatcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacgtcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcatcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12536 - RNA, 9873 nt, synthetic construct
  misc_feature 1..9873: note = derived and/or modified CDS sequence (opt2) from DENV-3__GU131874__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcaccggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccacctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgcccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcgcccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggctccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcgccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12537 - RNA, 9873 nt, synthetic construct
  misc_feature 1..9873: note = derived and/or modified CDS sequence (opt2) from DENV-3__GU131875__SS-prME
  source 1..9873: mol_type = other RNA
acctccctctgcctcgtcatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcatcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatgacccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggtcgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12538 - RNA, 9873 nt, synthetic construct
  misc_feature 1..9873: note = derived and/or modified CDS sequence (opt2) from DENV-3__GU131877__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtaccgcggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgtcatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcatctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcatccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttctccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcatccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctctccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12539 - RNA, 9873 nt, synthetic construct
  misc_feature 1..9873: note = derived and/or modified CDS sequence (opt2) from DENV-3__GU131878__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcgccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagctcatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcaccggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgccatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12540 - RNA, 9873 nt, synthetic construct
  misc_feature 1..9873: note = derived and/or modified CDS sequence (opt2) from DENV-3__FJ898455__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacgtcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggccgtccagcacgagaacctcaagtacaccgtcatcatcaccgtccacaccggcgaccagcaccaggtcggcaacgagacccagggcgtcaccgccgagatcaccccccaggcctccaccgtcgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagacctccggcggcacctccatcttcgccggccacctcaagtgccgcctcaagatggacaagctcgagctcaagggcatgtcctacgccatgtgcctcaacgccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccatcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccatcgtcgtcggcgacgtcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgagatgtacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggccgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcatgtgctccaacaccatcttcaccctcaccgtcgcctggcgcaccgccaccctcatcctcgccgtcatctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccttcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccacaaggagggcgtcttccacaccatgtggcacgtcacccgcggcgccgtcctcacccacaacggcaagcgcctcgagcccaactgggccaacgtcaagaaggacctcatctcctacggcggcggctggaagctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgtcgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcgtcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccttctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatccgccgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcatcaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctcctcgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtgggccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12541 - RNA, 9873 nt, synthetic construct
  misc_feature 1..9873: note = derived and/or modified CDS sequence (opt2) from DENV-3__GQ199891__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggccgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12542 - RNA, 9873 nt, synthetic construct
  misc_feature 1..9873: note = derived and/or modified CDS sequence (opt2) from DENV-3__FJ898443__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggccgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcaccggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagatgaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagctcgagggcgccatctggtga

SEQ ID NO: 12543 - RNA, 9873 nt, synthetic construct
  misc_feature 1..9873: note = derived and/or modified CDS sequence (opt2) from DENV-3__FJ898444__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacgagcagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcgtcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcctacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtcccgcgagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagaagggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12544 - RNA, 9873 nt, synthetic construct
  misc_feature 1..9873: note = derived and/or modified CDS sequence (opt2) from DENV-3__FJ898445__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggccgtcatcttcaccctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagcgcgaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatggagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcctacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcatgctcgagaccaccaagcgcgacctcggcatgtccaaggagcccggcgtcgcctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcatccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcacccgcaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12545 - RNA, 9873 nt, synthetic construct
  misc_feature 1..9873: note = derived and/or modified CDS sequence (opt2) from DENV-3__GQ868571__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggccgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcatgctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12546 - RNA, 9873 nt, synthetic construct
  misc_feature 1..9873: note = derived and/or modified CDS sequence (opt2) from DENV-3__GU131951__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatgtccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgaggcccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcacccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccatcgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12547 - RNA, 9873 nt, synthetic construct
  misc_feature 1..9873: note = derived and/or modified CDS sequence (opt2) from DENV-3__GQ868572__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggccgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggtccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12548 - RNA, 9873 nt, synthetic construct
  misc_feature 1..9873: note = derived and/or modified CDS sequence (opt2) from DENV-3__GQ868573__SS-prME
  source 1..9873: mol_type = other RNA
acctccttctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggccgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcctcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12549 - RNA, 9873 nt, synthetic construct
  misc_feature 1..9873: note = derived and/or modified CDS sequence (opt2) from DENV-3__GQ868574__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggccgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttctcctactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcatgctcgagaccaccaagcgcgacctcggcatgtccaaggagcccggcgtcgcctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12550 - RNA, 9873 nt, synthetic construct
  misc_feature 1..9873: note = derived and/or modified CDS sequence (opt2) from DENV-3__GQ868575__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggccgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaacttctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgacaagatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtcccgcgagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagatccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12551 - RNA, 9873 nt, synthetic construct
  misc_feature 1..9873: note = derived and/or modified CDS sequence (opt2) from DENV-3__GU131953__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggccgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacgccgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctctccgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12552 - RNA, 9873 nt, synthetic construct
  misc_feature 1..9873: note = derived and/or modified CDS sequence (opt2) from DENV-3__GQ868577__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaagatcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcctacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcgcccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggagaacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12553 - RNA, 9873 nt, synthetic construct
  misc_feature 1..9873: note = derived and/or modified CDS sequence (opt2) from DENV-3__GU131954__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcctacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgtcatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgaccaaggagcccggcgccgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaaggtcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12554 - RNA, 9873 nt, synthetic construct
  misc_feature 1..9873: note = derived and/or modified CDS sequence (opt2) from DENV-3__GQ868578__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcaagtggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccacctccgagaaggaggagaacatggtcaagtccctcgtctccgccggctccggcgaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaagatcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcctacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtccccacccacctcgcccaccgcacccgcaacgccctcgacaacctcgtcatgctccacacctccgagcacggcggcaaggcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcgcccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatgggcaacgaggagttcctcgactacatgccctccatgaagcgcttccgcaaggaggaggagtccgagggcgccatctggtga

SEQ ID NO: 12555 - RNA, 9873 nt, synthetic construct
  misc_feature 1..9873: note = derived and/or modified CDS sequence (opt2) from DENV-3__FJ898457__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagaccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12556 - RNA, 9873 nt, synthetic construct
  misc_feature 1..9873: note = derived and/or modified CDS sequence (opt2) from DENV-3__KF955505__SS-prME
  source 1..9873: mol_type = other RNA
acctccctctgcctcatgatgatcctccccgccgccctcgccttccacctcacctcccgcaacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcccccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccccaagctcggctacatcctccgcgacatctccaagatccccggcggcgccatgtacgccgacgacaccgccggctgggacacccgcatcaccgaggacgacctccacaacgaggagaagatcccccaccagatggaccccgagcactcccgcctcgccaacgccatcttcaagctcacctaccagaacaaggtcgtcaaggtccagcgccccacccccaccggcaccgtcatggacatcatctcccgcaaggcccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatcaccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12557 - RNA, 9873 nt, synthetic construct
  misc_feature 1..9873: note = derived and/or modified CDS sequence (opt2) from DENV-3__FJ898464__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12558 - RNA, 9873 nt, synthetic construct
  misc_feature 1..9873: note = derived and/or modified CDS sequence (opt2) from DENV-3__JQ922556__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggcccccgcccgcggcgcccgccgcatggccatcctcggcgacaccgcctgggtcttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggcccctccacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtcccccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccttcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcggcaccggcacctccgccgacctcaccgtcgagcaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccccccagtggcagaagggcgaggaggtccaggtcatcaccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaaccgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgagaccgagtaccagaagaccaagctcaacgactgggacttcgtcggcaccaccgacatctccgagatgggcgccaacttcaaggccgaccgcgtcatcgacccccgccgctgcctcaagcccggcatcctcaccgacggccccgagggcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagatcaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcgtctccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagctcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccggctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcggccgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtcaccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12559 - RNA, 9873 nt, synthetic construct
  misc_feature 1..9873: note = derived and/or modified CDS sequence (opt2) from DENV-3__JQ922557__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagcgcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatgtgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggcaagtccaagcgcgacaactccaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcatgctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcctcatcaccgtcgacgacaacggcaccatgcgcatcaaggacgacgagaccgagatcatcctcaccgtcctcctcaagaccgccctccagatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcgactacctctccggcatcgcccagaccaacgccgagccctacggcccctcccccgacctcgaggaggagatgttcaagaagcgcaagctcaccatcatggacctccaccccggctccggccagaccctcaagtacctccccgccatcgtccgcgacgccatcaagcgccgcctccgcatcctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgccgagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgagaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccaagcgcgtcatcctcgccggccccatgcccgacaccgccgcctccgccgcccagcgccgcggccgcgtcggccgcaacccccagaaggagaacgaccagtacatcttccccggccagcccctcaacaccgacgaggaccacgcccactggcccgagaccaagctcctcatggacctcttcaccacccccgagggcatcctcccctcccacttcgacccccacggcgagaacttccccgagatctccggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgactcccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatcaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatgaccaccctctgggagggctcccccggcaagatctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccgccgtcatcgagcacctcgagcgcctccagcgcaagcacggcggcatgctcgtccgcaaccccctctcccgcaactccacccacgagatgcactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgcctcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaaccccccctacctcggcaagcgcgaggaccagtggtgcggctccatcatcggcctctcctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12560 - RNA, 9873 nt, synthetic construct
  misc_feature 1..9873: note = derived and/or modified CDS sequence (opt2) from DENV-3__JQ922555__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccgccgaggccatcctccccgagtacggcaccctcggcctcgagtgctccccccgcaccggcctcgacttcaacgagatgatcctcctcaccatgaagaacaaggcctggatgggccaccgccagatgctcttcgacctccccaccccctggacctccggcaccaccaccgagacctccgcctggaaccgcaaggagcccttcgtcaccttcaagaacgcccacaccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcgtcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtaccgcaagggctcctccatcggcaagatgttcgaggccacctcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagatctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctccacctggcccaagtcccacaccctctggtccaacggcgtccaggagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgcctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccgcaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacggcgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccacctccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgacgccaagatgctcctcgagaacatcaacacccccgagggcatcatccccgccctcttcgagcccgagcgcgagaagtccgccggcctcgacggcgagtaccgcctcaagggcgagtcccgcaagaccttcgtcgagctcatgcgccgcggcgacctccccgtctggctcgcccacaaggtcgcctccgagggcatcctctacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtctcctcccacctcgcccaccgcacccgcaacgccctcgacaacaagatgatgctccacacctccgagtacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcgtctccaaggagcccggcgtcgtctcccccacctcctacctcgacgtcgacctccaccccgcctccgcctggaccctctacgccgtcgccaccaccgtcatcgcccccatgctccgccacaccatcgagaactccaccgccaacgtctccatggccgccatcgccaaccaggccgtcgtcctcatgggcctcgacaagggctggcccatctccaagatggacctcggcgtccccctcctcgccctcggctgctacttctacgtcaaccccctcaccctcaccgccgccgtcttcctcctcgtcacccactacgccatcatcggccccggcctccaggccaaggccacccgcgaggcccacaagaagaccgccgccggcatcatgaaccccccccccggcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccaccaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggcaagggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactcccgcaacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgcctcatgccccgcacccgcaaggtcatggagatcaccgccgagtggctctggcgcaccctcggccgcaacaagcgcccccgcctctgcacccgcgaggagttcaccaagaaggtccgccccatcgccgccatgggcgccgtcttcacccagcgcgaccagtgggactccgccaaggccgccgtcgaggacgaggagttctggaagcccgtcgaccgcgagtgcaactcccaccagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcaacaccgaggacgacctccacatgaaggagaagatcacccagcagatgggccccggccactcccgcctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12561 - RNA, 9873 nt, synthetic construct
  misc_feature 1..9873: note = derived and/or modified CDS sequence (opt2) from DENV-3__GU131903__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccactccggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgccccaacgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaaggccggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatggccaccggcatcgagcacctcgagcgcctccagcgcaagtacggcggcatgctcgtccgcaaccccctctcccgcaactccacccacgagatggactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12562 - RNA, 9873 nt, synthetic construct
  misc_feature 1..9873: note = derived and/or modified CDS sequence (opt2) from DENV-3__GU131904__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaactccatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctccgcaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatggccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12563 - RNA, 9873 nt, synthetic construct
  misc_feature 1..9873: note = derived and/or modified CDS sequence (opt2) from DENV-3__GU131906__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacaccccccgccgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcggcaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12564 - RNA, 9873 nt, synthetic construct
  misc_feature 1..9873: note = derived and/or modified CDS sequence (opt2) from DENV-3__GU131907__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcgccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcaccgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagaccgagggcgccatctggtga

SEQ ID NO: 12565 - RNA, 9873 nt, synthetic construct
  misc_feature 1..9873: note = derived and/or modified CDS sequence (opt2) from DENV-3__GQ868634__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12566 - RNA, 9873 nt, synthetic construct
  misc_feature 1..9873: note = derived and/or modified CDS sequence (opt2) from DENV-3__GU131908__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctggaagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12567 - RNA, 9873 nt, synthetic construct
  misc_feature 1..9873: note = derived and/or modified CDS sequence (opt2) from DENV-3__GU131909__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccttccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12568 - RNA, 9873 nt, synthetic construct
  misc_feature 1..9873: note = derived and/or modified CDS sequence (opt2) from DENV-3__GU131912__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcaccaacatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccatcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggctcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcgccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgcaagtcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgcctccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctccgcatggtcgagccctggctccgcaacaaccagttctgcatcaaggtcctcaacccctacatgcccaacgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccgaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12569 - RNA, 9873 nt, synthetic construct
  misc_feature 1..9873: note = derived and/or modified CDS sequence (opt2) from DENV-3__GU131913__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccatcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcgtcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtccacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcgccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgcaagtcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaacgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccgaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatgggcgacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12570 - RNA, 9873 nt, synthetic construct
  misc_feature 1..9873: note = derived and/or modified CDS sequence (opt2) from DENV-3__GU131914__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccatcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtccacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcgccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgcaagtcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaacgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccgaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatgggcgacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12571 - RNA, 9873 nt, synthetic construct
  misc_feature 1..9873: note = derived and/or modified CDS sequence (opt2) from DENV-3__GU131915__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggccgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccactccggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12572 - RNA, 9873 nt, synthetic construct
  misc_feature 1..9873: note = derived and/or modified CDS sequence (opt2) from DENV-3__GU131916__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcatcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcacctccggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgaggacgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttctccgactacatgccctccatgaagcgcttccgcaaggaggaggagtccgagggcgccatctggtga

SEQ ID NO: 12573 - RNA, 9873 nt, synthetic construct
  misc_feature 1..9873: note = derived and/or modified CDS sequence (opt2) from DENV-3__GU131917__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcaccctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcgccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgctccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcatccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctctccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12574 - RNA, 9873 nt, synthetic construct
  misc_feature 1..9873: note = derived and/or modified CDS sequence (opt2) from DENV-3__GU131918__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgctccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcatccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctctccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12575 - RNA, 9873 nt, synthetic construct
  misc_feature 1..9873: note = derived and/or modified CDS sequence (opt2) from DENV-3__GU131933__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaactccatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccatgggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatggccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12576 - RNA, 9873 nt, synthetic construct
  misc_feature 1..9873: note = derived and/or modified CDS sequence (opt2) from DENV-3__GU131934__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctggatcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcgtcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagaaccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcgccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatccccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagaccgagggcgccatctggtga

SEQ ID NO: 12577 - RNA, 9873 nt, synthetic construct
  misc_feature 1..9873: note = derived and/or modified CDS sequence (opt2) from DENV-3__GU131935__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgtcatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcaccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12578 - RNA, 9873 nt, synthetic construct
  misc_feature 1..9873: note = derived and/or modified CDS sequence (opt2) from DENV-3__GU131936__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcgccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcgccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgaagatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgctccaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagaccgagggcgccatctggtga

SEQ ID NO: 12579 - RNA, 9873 nt, synthetic construct
  misc_feature 1..9873: note = derived and/or modified CDS sequence (opt2) from DENV-3__GU131937__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccaccctccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatctccctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagaaccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12580 - RNA, 9873 nt, synthetic construct
  misc_feature 1..9873: note = derived and/or modified CDS sequence (opt2) from DENV-3__GU131938__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcgccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcgccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgaagatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcatgggccagcccctcaacaacgacgaggaccacgcccactggaccgaggccaagatgctcctcgacaacatcaacacccccgaggccatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgctccaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagaccgagggcgccatctggtga

SEQ ID NO: 12581 - RNA, 9873 nt, synthetic construct
  misc_feature 1..9873: note = derived and/or modified CDS sequence (opt2) from DENV-3__GU131939__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccatcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcgccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgcaagtcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagcgcgtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaacgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccgaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12582 - RNA, 9873 nt, synthetic construct
  misc_feature 1..9873: note = derived and/or modified CDS sequence (opt2) from DENV-3__GU131940__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcaccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcctacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12583 - RNA, 9873 nt, synthetic construct
  misc_feature 1..9873: note = derived and/or modified CDS sequence (opt2) from DENV-3__GU131942__SS-prME
  source 1..9873: mol_type = other RNA
acctccctctgcctcatgatgatgttccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccactccggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccgtcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcgccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12584 - RNA, 9873 nt, synthetic construct
  misc_feature 1..9873: note = derived and/or modified CDS sequence (opt2) from DENV-3__GU131943__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccatctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctgggccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12585 - RNA, 9873 nt, synthetic construct
  misc_feature 1..9873: note = derived and/or modified CDS sequence (opt2) from DENV-3__GU131945__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcgccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcgccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgaagatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgctccaaccagttctgcatcaaggtcctcaacccctacatgcccaccgtcatcgagtacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagaccgagggcgccatctggtga

SEQ ID NO: 12586 - RNA, 9873 nt, synthetic construct
  misc_feature 1..9873: note = derived and/or modified CDS sequence (opt2) from DENV-3__GU131946__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcatcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggcccgcatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcctcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgctccgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggacaacgcccgcgccgccgtcgaggacgaggagttctggaagctcgtcgaccgcgagcgcgagctccacaagctcggcaagtgcggctcctgcatctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgaccgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12587 - RNA, 9873 nt, synthetic construct
  misc_feature 1..9873: note = derived and/or modified CDS sequence (opt2) from DENV-3__FJ639712__SS-prME
  source 1..9873: mol_type = other RNA
acctccctctgcctcatgatgatgttccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccactccggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgagtgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacgccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12588 - RNA, 9873 nt, synthetic construct
  misc_feature 1..9873: note = derived and/or modified CDS sequence (opt2) from DENV-3__FJ639713__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcgccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgctccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcatccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctctccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12589 - RNA, 9873 nt, synthetic construct
  misc_feature 1..9873: note = derived and/or modified CDS sequence (opt2) from DENV-3__FJ639714__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagtccggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcgccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccatcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccggccaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagaccgagggcgccatctggtga

SEQ ID NO: 12590 - RNA, 9873 nt, synthetic construct
  misc_feature 1..9873: note = derived and/or modified CDS sequence (opt2) from DENV-3__FJ639715__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcaccaacatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccatcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcgccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgcaagtcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaacgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccgaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12591 - RNA, 9873 nt, synthetic construct
  misc_feature 1..9873: note = derived and/or modified CDS sequence (opt2) from DENV-3__KF955461__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccaggtcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgccatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccaccagctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12592 - RNA, 9873 nt, synthetic construct
  misc_feature 1..9873: note = derived and/or modified CDS sequence (opt2) from DENV-3__FJ639719__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgccaccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcatccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacccacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcgtctccggcaagggcatcggcaagaccaccatcggcctcatctgcgtcatcgtctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaacaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12593 - RNA, 9873 nt, synthetic construct
  misc_feature 1..9873: note = derived and/or modified CDS sequence (opt2) from DENV-3__KF955332__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgccaccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcatccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacgcccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcgtctccggcaagggcatcggcaagaccaccatcggcctcatctgcgtcatcgtctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaagaccgacctcgagaacccccacctcctcgagaagaagatcacccagtggctcgagaacaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12594 - RNA, 9873 nt, synthetic construct
  misc_feature 1..9873: note = derived and/or modified CDS sequence (opt2) from DENV-3__FJ639720__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgccaccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcatccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctccgcatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccatcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcgtctccggcaagggcatcggcaagaccaccatcggcctcatctgcgtcatcgtctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaagaccgacctcgagaacccccacctcctcgagaagaagatcacccagtggctcgagaacaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12595 - RNA, 9873 nt, synthetic construct
  misc_feature 1..9873: note = derived and/or modified CDS sequence (opt2) from DENV-3__GQ868626__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgccaccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcatccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccatcgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctccgcaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcctacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagaccaccatcggcctcatctgcgtcatcgtctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaacaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcgccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12596 - RNA, 9873 nt, synthetic construct
  misc_feature 1..9873: note = derived and/or modified CDS sequence (opt2) from DENV-3__GQ868627__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgccaccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcatccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctccgcaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcctacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagaccaccatcggcctcatctgcgtcatcgtctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaacaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcgccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12597 - RNA, 9873 nt, synthetic construct
  misc_feature 1..9873: note = derived and/or modified CDS sequence (opt2) from DENV-3__FJ639721__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgccaccggcatcaacatgtgcaccctcatcgccatggacctcggcgagatgtgcgacgacaccgtcacctacaagtgccccctcatcgtcgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcatccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcaccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacgcccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcgtctccggcaagggcatcggcaagaccaccatcggcctcatctgcgtcatcgtctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaagaccgacctcgagaacccccacctcctcgagaagaagatcacccagtggctcgagaacaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12598 - RNA, 9873 nt, synthetic construct
  misc_feature 1..9873: note = derived and/or modified CDS sequence (opt2) from DENV-3__FJ639722__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgccaccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcatccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgagaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacgcccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcgtctccggcaagggcatcggcaagaccaccatcggcctcatctgcgtcatcgtctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaagaccgacctcgagaacccccacctcctcgagaagaagatcacccagtggctcgagaacaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12599 - RNA, 9873 nt, synthetic construct
  misc_feature 1..9873: note = derived and/or modified CDS sequence (opt2) from DENV-3__FJ639723__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgccaccggcatcaacatgtgcaccctcatcgccatggacctcggcgagatgtgcgacgacaccgtcacctacaagtgccccctcatcgccgaggtcgagcccgaggacatcgactgctggtgcaacctcacctccgcctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcatccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctccgcaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccaccaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccacccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcctacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagaccaccatcggcctcatctgcgtcatcgtctcctccggcatgctctggatggccgacatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaacaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcgccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12600 - RNA, 9873 nt, synthetic construct
  misc_feature 1..9873: note = derived and/or modified CDS sequence (opt2) from DENV-3__FJ639724__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagcgcgtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccaccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12601 - RNA, 9873 nt, synthetic construct
  misc_feature 1..9873: note = derived and/or modified CDS sequence (opt2) from DENV-3__FJ639725__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcggcaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12602 - RNA, 9873 nt, synthetic construct
  misc_feature 1..9873: note = derived and/or modified CDS sequence (opt2) from DENV-3__FJ639726__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagcgcgtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctctcccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12603 - RNA, 9873 nt, synthetic construct
  misc_feature 1..9873: note = derived and/or modified CDS sequence (opt2) from DENV-3__KF955333__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgcccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaagcccgccgacgtcccctgggaggaggaggccgagcagaccggcgtctcccacaacctcatgatcaccgtcgacgacgacggccccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcaccgcccagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12604 - RNA, 9873 nt, synthetic construct
  misc_feature 1..9873: note = derived and/or modified CDS sequence (opt2) from DENV-3__GQ868628__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcgcctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12605 - RNA, 9873 nt, synthetic construct
  misc_feature 1..9873: note = derived and/or modified CDS sequence (opt2) from DENV-3__FJ639727__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaagtcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctactacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgccctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcgtcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttccgcgccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12606 - RNA, 9873 nt, synthetic construct
  misc_feature 1..9873: note = derived and/or modified CDS sequence (opt2) from DENV-3__GQ868629__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccatcaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12607 - RNA, 9873 nt, synthetic construct
  misc_feature 1..9873: note = derived and/or modified CDS sequence (opt2) from DENV-3__FJ639728__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgccctccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12608 - RNA, 9873 nt, synthetic construct
  misc_feature 1..9873: note = derived and/or modified CDS sequence (opt2) from DENV-3__FJ639729__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccatcaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggaacctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12609 - RNA, 9873 nt, synthetic construct
  misc_feature 1..9873: note = derived and/or modified CDS sequence (opt2) from DENV-3__FJ639730__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagaaggccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaacaaggagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgagctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagaagctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12610 - RNA, 9873 nt, synthetic construct
  misc_feature 1..9873: note = derived and/or modified CDS sequence (opt2) from DENV-3__KF955464__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccatcctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcaccaacatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccatcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggcaacggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcgccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgcaagtcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctccgcatggtcgagccctggctccgcaacaaccagttctgcatcaaggtcctcaacccctacatgcccaacgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgacaaggagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccgaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgcccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12611 - RNA, 9873 nt, synthetic construct
  misc_feature 1..9873: note = derived and/or modified CDS sequence (opt2) from DENV-3__FJ639731__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccgtcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaagatggacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaacaaggagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12612 - RNA, 9873 nt, synthetic construct
  misc_feature 1..9873: note = derived and/or modified CDS sequence (opt2) from DENV-3__HM181933__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgccatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgccgcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctcaacgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgaggccttcccccagtccaacgcccccatccaggacgaggagcgcgacatccccgagcgctcctggaactccggcaacgagtggatcaccgacttcgtcggcaagaccgtctggttcgtcccctccatcaaggccggcaacgacatcgccaactgcctccgcaagaacggcaagaaggtcatccagctctcccgcaagaccttcgacaccgagtaccagaagacccgcctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12613 - RNA, 9873 nt, synthetic construct
  misc_feature 1..9873: note = derived and/or modified CDS sequence (opt2) from DENV-3__JF295012__SS-prME
  source 1..9873: mol_type = other RNA
acctccctctgcctcatgatgatgctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgccccctcatcgccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagtccaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgacacccagggcgtcaccgtcgagatcaccccccaggcctccaccgtcgaggccgtcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaacaagaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcctcaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaaggccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctggatcatgaagatcggcatcggcgtcctcctcacctggatcggcctcaactccaagaacacctccatgtccttctcctgcatcgtcatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagtcctgcgaccaccgcctcatgtccgccgccatcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatcaacgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatgaccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccctctgccagtcctcctccatgcgcaagaccgactggctccccatgaccgtcgccgccatgggcgtcccccccctccccctcttcatcttctccctcaaggacacccccaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcatcttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcgtcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagcgcaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgtctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcgtcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcgtcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggccgccgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctccgcaacaaccagttctgcatcaaggtcctcaacccctacatgcccaccgtcatcgagcacctcgagcgcctccagcgcaagtacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcactcctccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgcccgcgccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaagggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactggatccccacctcccgcaccacctggtccatccacgcccaccaccagtggatgaccaccgaggacatgctcaccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcgacgaggagttcctcgactacatgccctccatgaagcgcttccgcaaggaggaggagtccgagggcgccatctggtga

SEQ ID NO: 12614 - RNA, 9873 nt, synthetic construct
  misc_feature 1..9873: note = derived and/or modified CDS sequence (opt2) from DENV-3__FJ898463__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccaccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaactcccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggaccaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12615 - RNA, 9873 nt, synthetic construct
  misc_feature 1..9873: note = derived and/or modified CDS sequence (opt2) from DENV-3__GQ868616__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccaccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcgtcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaactcccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgccctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcacccccgagtggctctggcgccccctcggccgcaacaagaagccccgcctctgcccccgcgaggagttcaccaagaaggtccgcaccaacgcccccatgggcgccgtcttcaccgaggagacccagtgggcctccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccccaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12616 - RNA, 9873 nt, synthetic construct
  misc_feature 1..9873: note = derived and/or modified CDS sequence (opt2) from DENV-3__GQ199887__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcgtcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgcctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatgttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttccgcaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgtcatgctcttcctcatctccggcaagggcatcggcaagacctccatcggcctcatctgcgtcatcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagcgcgacgtcgacctcggcgccggcacccgccacgtcaacgccgagcccgagatccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12617 - RNA, 9873 nt, synthetic construct
  misc_feature 1..9873: note = derived and/or modified CDS sequence (opt2) from DENV-3__GQ199888__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcgtcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcaccggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgcctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatgttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttccgcaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagcgcgacgtcgacctcggcgccggcacccgccacgtcaacgccgagcccgagatccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgaggacgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12618 - RNA, 9873 nt, synthetic construct
  misc_feature 1..9873: note = derived and/or modified CDS sequence (opt2) from DENV-3__GQ252674__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcatcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgacgtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcctcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaacgccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagcgcggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatccccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgcaaggtcatgggcatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgacaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggtccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggagaacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12619 - RNA, 9873 nt, synthetic construct
  misc_feature 1..9873: note = derived and/or modified CDS sequence (opt2) from DENV-3__GQ199889__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatcctcgtcaccccctccatggccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccatcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgcctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcatgctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagacctccgccgagcccgacggccccacccccgagctcgaggaggagatgttccgcaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccgccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagcgcgacgtcgacctcggcgccggcacccgccacgtcaacgccgagcccgagatccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12620 - RNA, 9873 nt, synthetic construct
  misc_feature 1..9873: note = derived and/or modified CDS sequence (opt2) from DENV-3__FJ882571__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgacgtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcctcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcctcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcatcgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatgggcatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgacaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggtccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggcatgcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcgccgtctggaaccgcgtctggatcgaggacaacccctggatggaggacaagacccccgtcaccacctgggaggacgtcccctacctcggcaagcgcgaggaccagtggtgcggctccctcatcggcctcacctcccgcgccacctgggcccagaacatcctcaccgccatccagcaggtccgctccctcatcggcaacgaggagttcctcgactacatgccctccatgaagcgcttccgcaaggaggaggagtccgagggcgccatctggtga

SEQ ID NO: 12621 - RNA, 9873 nt, synthetic construct
  misc_feature 1..9873: note = derived and/or modified CDS sequence (opt2) from DENV-3__FJ882572__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagtccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagatccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccttcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgcctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatgttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcatgctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagacctccgccgagcccgacggccccacccccgagctcgaggaggagatgttccgcaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgacgtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagaccacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagcgcgacgtcgacctcggcgccggcacccgccacgtcaacgccgagcccgagatccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctcctcgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12622 - RNA, 9873 nt, synthetic construct
  misc_feature 1..9873: note = derived and/or modified CDS sequence (opt2) from DENV-3__FJ882573__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctgggcctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacccccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccaccggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcgtctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgaggtccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatgatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcgtccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcgtcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatggagatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcatccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctcaccaaggccgacctcgagaacccccacctcctcgagaagaagatcacccagtggctcgaggccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggagaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12623 - RNA, 9873 nt, synthetic construct
  misc_feature 1..9873: note = derived and/or modified CDS sequence (opt2) from DENV-3__FJ898440__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccatcaccgaggccatcctccccgagtacggcaccctcggcctcgagtgctccccccgcaccggcctcgacttcaacgagatggtcctcctcaccatgaagaacaaggcctggatggtccaccgccagtggttcttcgacctccccctcccctggacctccggcgccaccaccgagacccccatctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtccagcccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagaaggacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatgaaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12624 - RNA, 9873 nt, synthetic construct
  misc_feature 1..9873: note = derived and/or modified CDS sequence (opt2) from DENV-3__FJ898441__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaagatggtccagtacgagaacctcaagtacaccgtcatcatcaccgtccacaccggcgaccagcaccaggtcggcaacgagacccagggcgtcaccgccgagatcaccccccaggcctccatcaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcaccaccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccaggtcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgtcggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgccgacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtccagcccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagaaggacctcggcatgtccaaggagcccggcgtcgtctcctccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgaccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagcgcgacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgcaaggtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaccatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12625 - RNA, 9873 nt, synthetic construct
  misc_feature 1..9873: note = derived and/or modified CDS sequence (opt2) from DENV-3__FJ898442__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaagatggtccagtacgagaacctcaagtacaccgtcatcatcaccgtccacaccggcgaccagcaccaggtcggcaacgagacccagggcgtcaccgccgagatcaccccccaggcctccatcaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcaccaccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccaggtcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacaccggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatcccccgctccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgccgacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtccagcccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagaaggacctcggcatgtccaaggagcccggcgtcgtctcctccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgaccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagcgcgacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgcaaggtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaccatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgagaacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12626 - RNA, 9873 nt, synthetic construct
  misc_feature 1..9873: note = derived and/or modified CDS sequence (opt2) from DENV-3__FJ882575__SS-prME
  source 1..9873: mol_type = other RNA
acctccctctgcctcatgatgatcctccccgccaccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgccccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcatcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcgacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgccccatgcccggcacccgcaaggtcatgggcatcaccgccgagtggctctggcgcaccctcggccgcaacaagcgcccccgcctctgcacccgcgaggagttcaccaagaaggtccgcaccaacgccgccatgggcgccgtcttcaccgaggagaaccagtgggactccgccaaggccgccgtcgaggacgaggagttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcgtccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12627 - RNA, 9873 nt, synthetic construct
  misc_feature 1..9873: note = derived and/or modified CDS sequence (opt2) from DENV-3__GQ199886__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatgggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacaccatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagaaggacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12628 - RNA, 9873 nt, synthetic construct
  misc_feature 1..9873: note = derived and/or modified CDS sequence (opt2) from DENV-3__FJ882576__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatggccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccgtcctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgcctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaactaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatgaccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacgtcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcgcctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggcgagcgcaacaaccagatcctcgaggagaacatggacgtcgagatctggaccaaggagggcgagaagaagaagctccgcccccgctggctcgacgcccgcacctactccgaccccctcgccctcaaggagttcaaggacttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggagttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtctcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctccgcgagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12629 - RNA, 9873 nt, synthetic construct
  misc_feature 1..9873: note = derived and/or modified CDS sequence (opt2) from DENV-3__FJ850052__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacaaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12630 - RNA, 9873 nt, synthetic construct
  misc_feature 1..9873: note = derived and/or modified CDS sequence (opt2) from DENV-3__FJ873812__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatctccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcctcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12631 - RNA, 9873 nt, synthetic construct
  misc_feature 1..9873: note = derived and/or modified CDS sequence (opt2) from DENV-3__FJ873813__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgctaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12632 - RNA, 9873 nt, synthetic construct
  misc_feature 1..9873: note = derived and/or modified CDS sequence (opt2) from DENV-3__FJ850048__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12633 - RNA, 9873 nt, synthetic construct
  misc_feature 1..9873: note = derived and/or modified CDS sequence (opt2) from DENV-3__FJ850049__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccatgtgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccaacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12634 - RNA, 9873 nt, synthetic construct
  misc_feature 1..9873: note = derived and/or modified CDS sequence (opt2) from DENV-3__FJ898476__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12635 - RNA, 9873 nt, synthetic construct
  misc_feature 1..9873: note = derived and/or modified CDS sequence (opt2) from DENV-3__FJ898475__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcctcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12636 - RNA, 9873 nt, synthetic construct
  misc_feature 1..9873: note = derived and/or modified CDS sequence (opt2) from DENV-3__GQ199861__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccatgtgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggccaacgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12637 - RNA, 9873 nt, synthetic construct
  misc_feature 1..9873: note = derived and/or modified CDS sequence (opt2) from DENV-3__GQ199862__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcctcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccgtcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12638 - RNA, 9873 nt, synthetic construct
  misc_feature 1..9873: note = derived and/or modified CDS sequence (opt2) from DENV-3__GQ199863__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggtcatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcatctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12639 - RNA, 9873 nt, synthetic construct
  misc_feature 1..9873: note = derived and/or modified CDS sequence (opt2) from DENV-3__GQ199864__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcaacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatcggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12640 - RNA, 9873 nt, synthetic construct
  misc_feature 1..9873: note = derived and/or modified CDS sequence (opt2) from DENV-3__GQ199865__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccatgtgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctggggcgaggaggccgagcagaccggcgtctcccacatgctcatgatcaccgtcgaggacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12641 - RNA, 9873 nt, synthetic construct
  misc_feature 1..9873: note = derived and/or modified CDS sequence (opt2) from DENV-3__GQ199870__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtcctggatctccaacggcaccggcaacatcgtcgcctccgtcaacatggtctcccgcctcctcctcaaccgctccaccatgacccaccgccgccccaccatcgagaaggacgtcgacctcggcgccggcccccgccacgtcaacgccgaccccgagccccccaacatggacgtcatcggcgagcgcatcaagcgcgtcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcccccagatggccatgaccgacaccacccccttcggccagcagcgcgtcttcaaggagaaggtcgacacccgcaccccccgctccatccccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12642 - RNA, 9873 nt, synthetic construct
  misc_feature 1..9873: note = derived and/or modified CDS sequence (opt2) from DENV-3__JF937630__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacgccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12643 - RNA, 9873 nt, synthetic construct
  misc_feature 1..9873: note = derived and/or modified CDS sequence (opt2) from DENV-3__JN000936__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcgtcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccatgtgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcacctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgacgacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12644 - RNA, 9873 nt, synthetic construct
  misc_feature 1..9873: note = derived and/or modified CDS sequence (opt2) from DENV-3__HQ541796__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacaccgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctcaccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12645 - RNA, 9873 nt, synthetic construct
  misc_feature 1..9873: note = derived and/or modified CDS sequence (opt2) from DENV-3__HQ166034__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccatgtgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgtcgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcgccgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12646 - RNA, 9873 nt, synthetic construct
  misc_feature 1..9873: note = derived and/or modified CDS sequence (opt2) from DENV-3__HM756274__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacgccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacccacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12647 - RNA, 9873 nt, synthetic construct
  misc_feature 1..9873: note = derived and/or modified CDS sequence (opt2) from DENV-3__HM756275__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccatgtgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgtcgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12648 - RNA, 9873 nt, synthetic construct
  misc_feature 1..9873: note = derived and/or modified CDS sequence (opt2) from DENV-3__JF937632__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatcggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagcgcgccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggcccccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccaccgcctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12649 - RNA, 9873 nt, synthetic construct
  misc_feature 1..9873: note = derived and/or modified CDS sequence (opt2) from DENV-3__HM756281__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcgtcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccaaggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttccgcgagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12650 - RNA, 9873 nt, synthetic construct
  misc_feature 1..9873: note = derived and/or modified CDS sequence (opt2) from DENV-3__JF937643__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagaaggccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcgcccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcgccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccgtcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgacgacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12651 - RNA, 9873 nt, synthetic construct
  misc_feature 1..9873: note = derived and/or modified CDS sequence (opt2) from DENV-3__HM181972__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgtcctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctggggcaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12652 - RNA, 9873 nt, synthetic construct
  misc_feature 1..9873: note = derived and/or modified CDS sequence (opt2) from DENV-3__HM631857__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacaccgcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgccgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccgtcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgtcgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12653 - RNA, 9873 nt, synthetic construct
  misc_feature 1..9873: note = derived and/or modified CDS sequence (opt2) from DENV-3__HM631860__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcgtcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccaaggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacacctacttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12654 - RNA, 9873 nt, synthetic construct
  misc_feature 1..9873: note = derived and/or modified CDS sequence (opt2) from DENV-3__HM181977__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcgtcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccaaggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12655 - RNA, 9873 nt, synthetic construct
  misc_feature 1..9873: note = derived and/or modified CDS sequence (opt2) from DENV-3__HM181978__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctcctccgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12656 - RNA, 9873 nt, synthetic construct
  misc_feature 1..9873: note = derived and/or modified CDS sequence (opt2) from DENV-3__JN183884__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaagatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttcggcctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12657 - RNA, 9873 nt, synthetic construct
  misc_feature 1..9873: note = derived and/or modified CDS sequence (opt2) from DENV-3__HQ541785__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcgccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcacctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgacgacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12658 - RNA, 9873 nt, synthetic construct
  misc_feature 1..9873: note = derived and/or modified CDS sequence (opt2) from DENV-3__HM181975__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcgtcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccatgtgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgtcgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgatccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12659 - RNA, 9873 nt, synthetic construct
  misc_feature 1..9873: note = derived and/or modified CDS sequence (opt2) from DENV-3__HM631864__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagaaggccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaactccaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagacctaccagctctggaccgccctcatctccctcacctgctccaacaccatcttcaccctcaccgtcgcctggcgcaccgccaccctcatcctcgccggcgtctccctcctccccgtctgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcgccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccgtcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgccgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggaagctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgacgacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga

SEQ ID NO: 12660 - RNA, 9873 nt, synthetic construct
  misc_feature 1..9873: note = derived and/or modified CDS sequence (opt2) from DENV-3__HM631859__SS-prME
  source 1..9873: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagcacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgccggctccggcaaggtcgacaacttcaccatgggcgtcctctgcctcgccatcctcttcgaggaggtcatgcgcggcaagttcggcaagaagcacatgatcgccggcgtcttcttcaccttcgtcctcctcctctccggccagatcacctggcgcgacatggcccacaccctcatcatgatcggctccaacgcctccgaccgcatgggcatgggcgtcacctacctcgccctcatcgccaccttcaagatccagcccttcctcgccctcggcttcttcctccgcaagctcacctcccgcgagaacctcctcctcggcgtcggcctcgccatggccaccaccctccagctccccgaggacatcgagcagatggccaacggcatcgccctcggcctcatggccctcaagctcatcacccagttcgagatctaccagctctggaccgccctcatctccctcacctgctccaacaccatcttcaccctcaccgtcgcctggcgcaccgccaccctcatcctcgccggcgtctccctcctccccatgtgccagtcctcctccatgcgcaagaccgactggctccccatggccgtcgccgccatgggcgtcccccccctccccctcttcatcttctccctcaaggacaccctcaagcgccgctcctggcccctcaacgagggcgtcatggccgtcggcctcgtctccatcctcgcctcctccctcctccgcaacgacgtccccatggccggccccctcgtcgccggcggcctcctcatcgcctgctacgtcatcaccggcacctccgccgacctcaccgtcgagaaggccgccgacatcacctgggaggaggaggccgagcagaccggcgtctcccacaacctcatgatcaccgtcgacgacgacggcaccatgcgcatcaaggacgacgagaccgagaacatcctcaccgtcctcctcaagaccgccctcctcatcgtctccggcatcttcccctactccatccccgccaccctcctcgtctggcacacctggcagaagcagacccagcgctccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaagtccatcgccctcgacctcgtcaccgagatcggccgcgtcccctcccacctcgcccaccgcacccgcaacgccctcgacaacctcgtcatgctccacacctccgagcacggcggccgcgcctaccgccacgccgtcgaggagctccccgagaccatggagaccctcctcctcctcggcctcatgatcctcctcaccggcggcgccatgctcttcctcatctccggcaagggcatcggcaagacctccatcggcctcatctgcgtcatcgcctcctccggcatgctctggatggccgagatccccctccagtggatcgcctccgccatcgtcctcgagttcttcatgatggtcctcctcatccccgagcccgagaagcagcgcaccccccaggacaaccagctcgcctacgtcgtcatcggcatcctcaccctcgccgccatcatcgccgccaacgagatgggcctcctcgagaccaccaagcgcgacctcggcatgtccaaggagcccggcgtcgtctcccccacctcctacctcgacgtcgacctccaccccgcctccgcctggaccctctacgccgtcgccaccaccgtcatcacccccatgctccgccacaccatcgagaactccaccgccaacgtctccctcgccgccatcgccaaccaggccgtcgtcctcatgggcctcgacaagggctggcccatctccaagatggacctcggcgtccccctcctcgccctcggctgctactcccaggtcaaccccctcaccctcaccgccgccgtcctcctcctcatcacccactacgccatcatcggccccggcctccaggccaaggccacccgcgaggcccagaagcgcaccgccgccggcatcatgaagaaccccaccgtcgacggcatcatgaccatcgacctcgaccccgtcatctacgactccaagttcgagaagcagctcggccaggtcatgctcctcgtcctctgcgtcgtccagctcctcctcatgcgcacctcctgggccctctgcgaggccctcaccctcgccaccggccccatcaccaccctctgggagggctcccccggcaagttctggaacaccaccatcgccgtctccatggccaacatcttccgcggctcctacctcgccggcgccggcctcgccttctccatcatgaagtccgtcggcaccggcaagcgcggcaccggctcccagggcgagaccctcggcgagaagtggaagaagaagctcaaccagctctcccgcaaggacttcgacctctacaagaagtccggcatcaccgaggtcgaccgcaccgaggccaaggagggcctcaagcgcggcgagatcacccaccacgccgtctcccgcggctccgccaagctccagtggttcgtcgagcgcaacatggtcatccccgagggccgcgtcatcgacctcggctgcggccgcggcggctggtcctactactgcgccggcctcaagaaggtcaccgaggtccgcggctacaccaagggcggccccggccacgaggagcccgtccccatgtccacctacggctggaacatcgtcaagctcatgtccggcaaggacgtcttctacctcccccccgagaagtgcgacaccctcctctgcgacatcggcgagtcctccccctcccccaccgtcgaggagtcccgcaccatccgcgtcctcaagatggtcgagccctggctcaagaacaaccagttctgcatcaaggtcctcaacccctacatgcccaccgtcatcgagcacctcgagcgcctccagcgcaagcacggcggcatgctcgtccgcaaccccctctcccgcaactccacccacgagatgtactggatctccaacggcaccggcaacatcgtcgcctccgtcaacatggtctcccgcctcctcctcaaccgcttcaccatgacccaccgccgccccaccatcgagaaggacgtcgacctcggcgccggcacccgccacgtcaacgccgagcccgagacccccaacatggacgtcatcggcgagcgcatcaagcgcatcaaggaggagcacaactccacctggcactacgacgacgagaacccctacaagacctgggcctaccacggctcctacgaggtcaaggccaccggctccgcctcctccatgatcaacggcgtcgtcaagctcctcaccaagccctgggacgtcgtccccatggtcacccagatggccatgaccgacaccacccccttcggccagcagcgcgtcttcaaggagaaggtcgacacccgcaccccccgctccatgcccggcacccgccgcgtcatgggcatcaccgccgagtggctctggcgcaccctcggccgcaacaagaagccccgcctctgcacccgcgaggagttcaccaagaaggtccgcaccaacgccgccatgggcgccgtcttcaccgaggagaaccagtgggactccgccaaggccgccgtcgaggacgaggacttctggcgcctcgtcgaccgcgagcgcgagctccacaagctcggcaagtgcggctcctgcgtctacaacatgatgggcaagcgcgagaagaagctcggcgagttcggcaaggccaagggctcccgcgccatctggtacatgtggctcggcgcccgctacctcgagttcgaggccctcggcttcctcaacgaggaccactggttctcccgcgagaactcctactccggcgtcgagggcgagggcctccacaagctcggctacatcctccgcgacatctccaagatccccggcggcgccatgtacgccgacgacaccgccggctgggacacccgcatcaccgaggacgacctccacaacgaggagaagatcacccagcagatggaccccgagcaccgccagctcgccaacgccatcttcaagctcacctaccagaacaaggtcgtcaaggtccagcgccccacccccaccggcaccgtcatggacatcatctcccgcaaggaccagcgcggctccggccaggtcggcacctacggcctcaacaccttcaccaacatggaggcccagctcatccgccagatggagggcgagggcgtcctctccaaggccgacctcgagaacccccacctccccgagaagaagatcacccagtggctcgagaccaagggcgtcgagcgcctcaagcgcatggccatctccggcgacgactgcgtcgtcaagcccatcgacgaccgcttcgccaacgccctcctcgccctcaacgacatgggcaaggtccgcaaggacatcccccagtggcagccctccaagggctggcacgactggcagcaggtccccttctgctcccaccacttccacgagctcatcatgaaggacggccgcaagctcgtcgtcccctgccgcccccaggacgagctcatcggccgcgcccgcatctcccagggcgccggctggtccctcaaggagaccgcctgcctcggcaaggcctacgcccagatgtggtccctcatgtacttccaccgccgcgacctccgcctcgcctccaacgccatctgctccgccgtccccgtccactgggtccccacctcccgcaccacctggtccatccacgcccaccaccagtggatgaccaccgaggacatgctcaccgtctggaaccgcgtctggatcgaggacaacccctggatggaggacaagacccccgtcaccacctgggagaacgtcccctacctcggcaagcgcgaggaccagtggtgcggctccctcatcggcctcacctcccgcgccacctgggcccagaacatccccaccgccatccagcaggtccgctccctcatcggcaacgaggagttcctcgactacatgccctccatgaagcgcttccgcaaggaggaggagtccgagggcgccatctggtga
